US011466259B2

(12) United States Patent
Micklitsch et al.

(10) Patent No.: US 11,466,259 B2
(45) Date of Patent: Oct. 11, 2022

(54) ENGINEERED GALACTOSE OXIDASE VARIANT ENZYMES

(71) Applicant: Codexis, Inc., Redwood City, CA (US)

(72) Inventors: Christopher Michael Micklitsch, Philadelphia, PA (US); Oscar Alvizo, Fremont, CA (US); Jovana Nazor, Milpitas, CA (US); Harvinder Chagger Maniar, Hayward, CA (US); Mikayla Jianghongxia Krawczyk, Palo Alto, CA (US); Margie Tabuga Borra-Garske, Palo Alto, CA (US); Nandhitha Subramanian, San Francisco, CA (US); Anna Fryszkowska, New York, NY (US); Nicholas M. Marshall, Rahway, NJ (US); Agustina Rodriguez-Granillo, Rahway, NJ (US); Deeptak Verma, Rahway, NJ (US); Dewan Andrews, Rahway, NJ (US)

(73) Assignee: Codexis, Inc., Redwood City, CA (US)

(*) Notice: Subject to any disclaimer, the term of this patent is extended or adjusted under 35 U.S.C. 154(b) by 0 days.

(21) Appl. No.: 16/460,376

(22) Filed: Jul. 2, 2019

(65) Prior Publication Data

US 2020/0010869 A1    Jan. 9, 2020

Related U.S. Application Data

(60) Provisional application No. 62/695,570, filed on Jul. 9, 2018, provisional application No. 62/822,286, filed on Mar. 22, 2019.

(51) Int. Cl.
| | |
|---|---|
| *C12N 9/04* | (2006.01) |
| *C12N 15/52* | (2006.01) |
| *C12P 21/02* | (2006.01) |
| *C12N 9/02* | (2006.01) |

(52) U.S. Cl.
CPC .......... *C12N 9/0006* (2013.01); *C12N 15/52* (2013.01); *C12N 9/001* (2013.01); *C12P 21/02* (2013.01); *C12Y 101/03009* (2013.01)

(58) Field of Classification Search
CPC ............................. C12N 9/001; C12N 9/0006
See application file for complete search history.

(56) References Cited

U.S. PATENT DOCUMENTS

| | | |
|---|---|---|
| 5,605,793 A | 2/1997 | Stemmer |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |

(Continued)

FOREIGN PATENT DOCUMENTS

| | | |
|---|---|---|
| WO | 95/22625 A1 | 8/1995 |
| WO | 95/33836 A1 | 12/1995 |

(Continued)

OTHER PUBLICATIONS

Studer. Residue mutations and their impact on protein structure and function: detecting beneficial and pathogenic changes. Biochem. J. (2013) 449, 581-594.*
Rannes. Glycoprotein Labeling Using Engineered Variants of Galactose Oxidase Obtained by Directed Evolution. |J. Am. Chem. Soc. 2011, 133, 8436-8439.*
Deacon (Enhanced fructose oxidase activity in a galactose oxidase variant. ChemBioChem 5:972-979(2004).*
P0CS93. NCBI Database. 2012.*
Wada, K., et al., "Codon usage tabulated from the GenBank genetic sequence data," Nucl. Acids Res., 20:2111-2118 [1992].
Wells, J.A., et al., "Cassette mutagenesis: an efficient method for generation of multiple mutations at defined sites," Gene, 34:315-323 (1985).

(Continued)

*Primary Examiner* — Yong D Pak
(74) *Attorney, Agent, or Firm* — Codexis, Inc.

(57) ABSTRACT

The present invention provides engineered galactose oxidase (GOase) enzymes, polypeptides having GOase activity, and polynucleotides encoding these enzymes, as well as vectors and host cells comprising these polynucleotides and polypeptides. Methods for producing GOase enzymes are also provided. The present invention further provides compositions comprising the GOase enzymes and methods of using the engineered GOase enzymes. The present invention finds particular use in the production of pharmaceutical and other compounds.

29 Claims, No Drawings
Specification includes a Sequence Listing.

(56) References Cited

U.S. PATENT DOCUMENTS

| | | |
|---|---|---|
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,605,430 B1 | 7/2003 | Affholter et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,098,010 B1 * | 8/2006 | Arnold ............... C12N 9/0006 435/189 |
| 7,105,297 B2 | 9/2006 | Minshull et al. |
| 7,148,054 B2 | 12/2006 | delCardayre et al. |
| 7,220,566 B2 | 5/2007 | Ness et al. |
| 7,288,375 B2 | 10/2007 | Stemmer et al. |
| 7,384,387 B1 | 6/2008 | Raillard et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | delCardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 9,714,437 B2 | 7/2017 | Chan et al. |
| 2003/0064432 A1 | 4/2003 | Rozzell et al. |
| 2008/0220990 A1 | 9/2008 | Fox |
| 2009/0312196 A1 | 12/2009 | Colbeck et al. |

FOREIGN PATENT DOCUMENTS

| | | |
|---|---|---|
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 00/42651 A1 | 7/2000 |
| WO | 01/62938 A2 | 8/2001 |
| WO | 01/75767 A2 | 10/2001 |
| WO | 2003/072742 A2 | 9/2003 |
| WO | 2009/152336 A1 | 12/2009 |

OTHER PUBLICATIONS

Wetmur, J. G., "DNA Probes: Applications of the Principles of Nucleic Acid Hybridization," Crit Rev Biochem Mol Biol, 26(3/4):227-259 (1991).

Wilson, I.A., et al., "The structure of antigenic determinant in a protein," Cell, 37:767-778 [1984].

Wright, F., "The 'effective number of codons' used in a gene," Gene 87:23-29 [1990].

You, B., et al., "Gene-specifc disruption in the fillamentous fungus *Cercospora nicotianae* using a split-marker approach," Arch Micriobiol., 191:615-622 [2009].

Zhang, J-H., et al., "Directed evolution of a fucosidase from a galactosidase by DNA shuffling and screening,"Proc. Nat. Acad. Sci., U.S.A., 94:4504-4509 (1997).

UniProtKB/Swiss-Prot Direct Submission GAOA-GIBZE dated May 23, 2018.

Altschul, S., et al., "Basic local alignment search tool," J. Mol. Biol., 215: 403-410 (1990).

Altschul, S.F., et al., "Gapped BLAST and PSI-BLAST: a new generation of protein database search programs," Nucleic Acids Res., 25(17):3389-3402 (1997).

Baldino, Jr., F., et al., "High-Resolution in Situ Hybridization Histochemistry," Methods Enzymology, 168:761-777 (1989).

Batzer, M.A., "Erratum: Structure and variability of recently inserted Alu family members", Nucleic Acids Res 19:698-699 [1991].

Bolton, E.T., et al., "A General Method for the lisolation of RNA Complementary to DNA," Proc. Natl. Acad. Sci. USA 48:1390 (1962).

Botstein, D., et al., "Strategies and applications of in vitro mutagenesis," Science, 229(4719):1193-1201, 1985.

Breslauer, K.J., et al., "Predicting DNA duplex stability from the base sequence," Proc. Natl. Acad. Sci. USA, 83:3746-3750 (1986).

Carter, P., "Site-directed mutagenesis," Biochem. J., 237:1-7 (1986).

Chaveroche, M., et al., "A rapid method for efficient gene replacement in the filamentous fungus *Aspergillus nidulans*," Nucl. Acids Res., 28:22 e97 [2000].

(56) References Cited

OTHER PUBLICATIONS

Cho, Y., et al., "A high throughput targeted gene disruption method for Alternaria brassicicola functional genomics using linear minimal element (LME) constructs," Mol Plant Microbe Interact,19(1):7-15 [2006].
Christians, F.C., et al., "Directed evolution of thymidine kinase for AZT phosphorylation using DNA family shuffling," Nat. Biotechnol., 17:259-264 (1999).
Combier, J.-P., et al., "Agrobacterium tumefaciens-mediated transformation as a tool for insertional mutagenesis in the symbiotic ectomycorrhizal fungus Hebeloma cylindrosporum," FEMS Microbiol Lett., 220:141-8 [2003].
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling,"Nat. Biotechnol., 14(3):315-319 (1996).
Crameri, A., et al., "Molecular evolution of an arsenate detoxification pathway by DNA shuffling," Nat. Biotechnol., 15 (5):436-438 (1997).
Dale, S.J., et al., "Oligonucleotide-directed random mutagenesis using the phosphorothioate method," Methods Mol. Biol., 57:369-74 (1996).
De Boer, H.A., et al., "The tac promoter: Afunctional hybrid derived from the trp and lac promoters," Proc. Natl Acad. Sci. USA, 80:21-25 (1983).
Ehrlich, S.D.,"DNA cloning in Bacillus subtilis," Proc. Natl. Acad. Sci. USA, 75(3):1433-1436 [1978].
Eisenberg, D., et al., "Analysis of Membrane and Surface Protein Sequences with the Hydrophobic Moment Plot," J. Mol. Biol., 179:125-142 [1984].
Firon, A., et al., "Identification of Essential Genes in the Human Fungal Pathogen Aspergillus fumigatus by Transposon Mutagenesis," Eukaryot. Cell, 2(2):247-55 [2003].
Freier, S.M., et al., "Improved free-energy parameters for predictions of RNA duplex stability," Proc. Natl. Acad. Sci USA, 83:9373-9377 (1986).
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coli* and *Salmonella*,"Analysis and predictions from *Escherichia coli* Sequences, or *E. coli* in silico," ASM Press, Washington D.C., [1987], pp. 2047-2066.
Henikoff, S., et al., "Amino acid substitution matrices from protein blocks," Proc. Natl. Acad. Sci. USA, 89:10915-10919 [1992].
Hong, J., et al., "Cloning and functional expression of thermostable beta-glucosidase gene from Thermoascus aurantiacus," Appl. Microbiol. Biotechnol, 73:1331-1339 [2007].
Kierzek, R., et al., "Polymer-Supported RNA Synthesis and Its Application To Test the Nearest-Neighbor Model for Duplex Stability," Biochemistry, 25:7840-7846 (1986).
Kramer, B., et al., "Different base/base mismatches are corrected with different efficiencies by the methyl-directed DNA mismatch-repair system of *E. coli*," Cell, 38(3):879-887 [1984].
Lathe, R., et al., "Plasmid and bacteriolphage vecotrs for excision of intact inserts," Gene, 57:193-201 [1987].
Ling, M.M., et al., "Approaches to DNA Mutagenesis: An Overview," Anal. Biochem., 254(2):157-78 [1997].
Maruyama, J., "Multiple gene disruptions by marker recycling with highly efficient gene-targeting background (delta-igD) in Aspergillus oryzae," Biotechnol Lett., 30:1811-1817 [2008].

McInerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Parry, N.J., et al., "Biochemical characterization and mechanism of action of a thermostablebeta-glucosidase purified from Thermoascus aurantiacus," Biochem. J., 353:117-127 [2001].
Pearson, W.R., "Improved tools for biological sequence comparison," Proc. Natl. Acad. Sci. USA, 85:2444-2448 (1988).
Porath, J., "Immobilized metal ion affinity chromatography," Protein Expression and Purification, 3:263-281 (1992).
Romanos, M.A., et al., "Foreign gene expression in yeast: a review," Yeast 8:423-488 [1992].
Rychlik, W., et al., "Optimization of the annealing temperature for DNA amplification in vitro," Nucleic Acids Res, 18 (21):6409-6412 (1990).
Simonen, M., et al., "Protein Secretion in *Bacillus* Species," Microbiological Reviews, 57:109-137 (1993).
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: In vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in Caenorhabditis elegans: delineation of translational selection and mutational biases," Nucl. Acids Res. 22(13):2437-46 [1994].
Suggs, S.V., et al., "Use of synthetic oligodeoxyribonucleotides for the isolation of specific cloned DNA sequences," In Developmental Biology Using Purified Genes (Brown et al., eds ), pp. 683-693, Academic Press (1981).
Takahashi, T., et al., "Efficient gene disruption in the koji-mold Aspergillus sojae using a novel variation of the positive-negative method," Mol. Gen. Genom., 272: 344-352 [2004].
Tiwari, S., et al., "Prediction of probable genes by Fourier analysis of genomic sequences," Comput. Appl. Biosci. 13 (3):263-270 [1997].
Uberbacher, E.C., et al., "Discovering and Understanding Genes in Human DNA Sequence Using GRAIL," Methods Enzymol., 266:259-281 [1996].
Villa-Komaroff, L., et al., "A bacterial clone synthesizing proinsulin," Proc. Natl Acad. Sci. USA, 75:3727-3731 (1978).
Escalettes, F., et al., "Directed Evolution of Galactose Oxidase: Generation of Enantioselective Secondary Alcohol Oxidases," ChemBioChem, 9(6):857-860 [2008].
Wilkinson, D., et al., "Structural and kinetic studies of a series of mutants of galactose oxidase identified by directed evolution," Protein Engineering, Design and Selection, 7(2):141-148 [2004].
Chappell, L.A., et al., "Engineering the Substrate Specificity of Galactose Oxidase," The University of Leeds, School of Molecular and Cellular Biology, pp. 1-263 [2013].
Lippow, S.M., et al., "Engineering Enzyme Specificity Using Computational Design of a Defined-Sequence Library," Chemistry & Biology, 17(12): 1306-1315 [2010].

\* cited by examiner

US 11,466,259 B2

ENGINEERED GALACTOSE OXIDASE VARIANT ENZYMES

The present application claims priority to U.S. Prov. Pat. Appln. Ser. No. 62/695,570, filed Jul. 9, 2018 and U.S. Prov. Pat. Appln. Ser. No. 62/822,286, filed Mar. 22, 2019, both of which are incorporated by reference in its entirety, for all purposes.

FIELD OF THE INVENTION

The present invention provides engineered galactose oxidase (GOase) enzymes, polypeptides having GOase activity, and polynucleotides encoding these enzymes, as well as vectors and host cells comprising these polynucleotides and polypeptides. Methods for producing GOase enzymes are also provided. The present invention further provides compositions comprising the GOase enzymes and methods of using the engineered GOase enzymes. The present invention finds particular use in the production of pharmaceutical and other compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-176WO2_ST25.txt", a creation date of Jul. 2, 2019 and a size of 11,509 kilobytes. The Sequence Listing filed via EFS-Web is part of the specification and incorporated in its entirety by reference herein.

BACKGROUND OF THE INVENTION

Oxidation of alcohols to aldehydes is a key transformation required in synthetic organic chemistry. There are several chemical reagents capable of performing this type of reaction, however there are several drawbacks associated with the use of these methods. Chemical oxidation routes are non-chemoselective methods, that when used, require the protection of non-targeted reactive groups. These methods of oxidation are difficult to control in terms of oxidation state, as some chemical reagents are capable of over-oxidizing the target alcohol. In addition, reactions run under oxidizing conditions present hazardous conditions that can result in explosions and severe physical harm to personnel and property. Oxidizing reagents are reactive species that are harmful to the environment, as well as their byproducts. Thus, there remains a need in the art to produce controlled agents capable of performing selective oxidation chemistry, while reducing or eliminating these severe drawbacks.

SUMMARY OF THE INVENTION

The present invention provides engineered galactose oxidase (GOase) enzymes, polypeptides having mild oxidative activity on primary alcohols resulting in the corresponding aldehyde, in an enantioselective manner, and polynucleotides encoding these enzymes, as well as vectors and host cells comprising these polynucleotides and polypeptides. Methods for producing GOase enzymes are also provided. The present invention further provides compositions comprising the GOase enzymes and methods of using the engineered GOase enzymes. The present invention finds particular use in the production of pharmaceutical and other compounds.

The present invention provides engineered galactose oxidases comprising polypeptide sequences having at least 85%, 86%, 87%, 88%, 89%, 90%, 91%, 92%, 93%, 94%, 95%, 96%, 97%, 98%, 99%, or more sequence identity to SEQ ID NO: 2, 4, 166, 272, 928, 932, 1264, 1416, 1598, 1866, 1912, 2080, 2300, and/or 2424, or a functional fragment thereof. In some embodiments, the engineered galactose oxidase comprises at least one substitution or substitution set in the polypeptide sequence, and wherein the amino acid positions of the polypeptide sequence are numbered with reference to SEQ ID NO: 2, 4, 166, 272, 928, 932, 1264, 1416, 1598, 1866, 1912, 2080, 2300, and/or 2424. In some additional embodiments of the engineered galactose oxidases the polypeptide sequences have at least 85%, 86%, 87%, 88%, 89%, 90%, 91%, 92%, 93%, 94%, 95%, 96%, 97%, 98%, 99%, or more sequence identity to SEQ ID NO:2. In some embodiments, the engineered galactose oxidase comprises at least one substitution or substitution set at one or more positions in the polypeptide sequence selected from 331/406/407/465 and 331/406/465, wherein the amino acid positions of the polypeptide sequence are numbered with reference to SEQ ID NO: 2. In some embodiments, the engineered galactose oxidase comprises at least one substitution or substitution set selected from 331R/406Y/407Q/465A, 331R/406Y/465A, and 331R/406Y/465Q, wherein the amino acid positions of the polypeptide sequence are numbered with reference to SEQ ID NO: 2. In some additional embodiments, the engineered galactose oxidase comprises at least one substitution or substitution set selected from K331R/F406Y/E407Q/F465A, K331R/F406Y/F465A, and K331R/F406Y/F465Q, wherein the amino acid positions of the polypeptide sequence are numbered with reference to SEQ ID NO: 2.

In some additional embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:4, and wherein the engineered galactose oxidase comprises at least one substitution or substitution set at one or more positions in the polypeptide sequence selected from 170, 171, 173, 191, 192, 193, 194, 197, 198, 199, 202, 204, 205, 220, 227, 243, 247, 248, 252, 269, 294, 296, 324, 332, 407, 463, 465, 466, 493, 515, 517, 520, 521, and 522, wherein the amino acid positions of the polypeptide sequence are numbered with reference to SEQ ID NO: 4. In some embodiments, the engineered galactose oxidase comprises at least one substitution or substitution set selected from 170L, 171A, 171C, 171L, 173C, 173S, 191A, 192I, 192M, 192Q, 193T, 194V, 197K, 197S, 198A, 198G, 198T, 199G, 199R, 199T, 202C, 202T, 204Q, 204S, 204V, 205A, 220E, 220P, 220R, 227L, 243C, 243V, 247G, 248E, 248T, 252T, 269Q, 269Y, 294K, 294N, 294S, 296A, 296L, 296S, 296W, 324G, 324S, 332R, 407V, 463K, 463R, 463V, 465G, 466R, 493G, 515T, 517D, 517E, 517L, 517M, 517S, 520G, 520L, 520P, 520S, 520V, 521G, 521P, 521S, 521V, and 522S, wherein the amino acid positions of the polypeptide sequence are numbered with reference to SEQ ID NO: 4. In some embodiments, the engineered galactose oxidase comprises at least one substitution or substitution set selected from I170L, V171A, V171C, V171L, A173C, A173S, R191A, N192I, N192M, N192Q, D193T, A194V, G197K, G197S, S198A, S198G, S198T, P199G, P199R, P199T, I202C, I202T, L204Q, L204S, L204V, T205A, V220E, V220P, V220R, M227L, T243C, T243V, D247G, A248E, A248T, S252T, V269Q, V269Y, G294K, G294N, G294S, F296A, F296L, F296S, F296W, A324G, A324S, S332R, E407V, I463K, I463R, I463V, A465G, E466R, V493G, L515T, G517D, G517E, G517L, G517M, G517S, T520G, T520L, T520P, T520S, T520V, T521G, T521P, T521S, T521V, and N522S, wherein the amino acid positions of the polypeptide sequence are numbered with reference to SEQ ID NO: 4.

In some further embodiments, the engineered galactose oxidase comprises a polypeptide sequence that has at least 85%, 86%, 87%, 88%, 89%, 90%, 91%, 92%, 93%, 94%, 95%, 96%, 97%, 98%, 99%, or more sequence identity to SEQ ID NO: 4, and wherein the engineered galactose oxidase comprises at least one substitution or substitution set at one or more positions in the polypeptide sequence selected from 171, 173, 188, 192, 197, 199, 203, 220, 223, 243, 252, 294, 295, 296, 332, 407, 465, 466, 493, 515, 517, 520, and 521, wherein the amino acid positions of the polypeptide sequence are numbered with reference to SEQ ID NO: 4. In some embodiments, the engineered galactose oxidase comprises at least one substitution or substitution set selected from 171A, 173S, 188T, 192Q, 197K, 197S, 197T, 199A, 199N, 199S, 203V, 220C, 220E, 220M, 220P, 220S, 223H, 223L, 223M, 223N, 243A, 243S, 252M, 252R, 252T, 252V, 294E, 294Q, 294S, 295E, 295G, 295N, 295R, 295S, 296S, 332Q, 407F, 407I, 407M, 465G, 465M, 465T, 466G, 466R, 493T, 515V, 517D, 517K, 517S, 520A, 520S, 521A, 521G, 521Q, 521V, and 521Y, wherein the amino acid positions of the polypeptide sequence are numbered with reference to SEQ ID NO: 4. In some embodiments, the engineered galactose oxidase comprises at least one substitution or substitution set selected from V171A, A173S, S188T, N192Q, G197K, G197S, G197T, P199A, P199N, P199S, T203V, V220C, V220E, V220M, V220P, V220S, T223H, T223L, T223M, T223N, T243A, T243S, S252M, S252R, S252T, S252V, G294E, G294Q, G294S, V295E, V295G, V295N, V295R, V295S, F296S, S332Q, E407F, E407I, E407M, A465G, A465M, A465T, E466G, E466R, V493T, L515V, G517D, G517K, G517S, T520A, T520S, T521A, T521G, T521Q, T521V, and T521Y, wherein the amino acid positions of the polypeptide sequence are numbered with reference to SEQ ID NO: 4.

In yet some further embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:166, and wherein the engineered galactose oxidase comprises at least one substitution or substitution set at one or more positions in the polypeptide sequence selected from 171/220/243/407/465, 171/220/295/296/407, 171/220/296/407/520, 171/220/332/407, 171/220/407, 171/220/465/520, 171/243/296/332, 171/295/296/332/465, 171/295/332, 171/296/407, 171/296/407/465, 171/332, 171/407, 171/407/520, 173, 173/192/243/465, 173/465, 192/220/295/296/332/521, 192/220/295/520/521, 192/220/296/332/520, 192/220/407, 192/294/465/515, 192/295/296, 192/295/296/332, 192/295/296/520/521, 192/296, 198/294/296, 198/295, 198/295/296, 204, 204/243/465/517/521, 220, 220/243, 220/243/295/296/332/407/521, 220/243/295/296/407, 220/243/407, 220/243/407/465, 220/243/407/520/521, 220/252/332/407, 220/295/296, 220/295/296/332, 220/295/296/332/407/465/521, 220/295/296/332/407/520, 220/295/296/332/407/521, 220/295/296/407, 220/295/296/465/520, 220/295/332, 220/295/332/465/520/521, 220/295/407/465, 220/295/407/520/521, 220/295/407/521, 220/295/465/520, 220/295/465/521, 220/296, 220/296/332/407, 220/296/332/407/520/521, 220/296/407, 220/296/465, 220/296/465/521, 220/332/407/465/521, 220/407, 220/407/520, 220/465, 220/465/517, 220/465/520, 221/227/243/465, 227, 243/295, 243/295/407, 243/515/517, 277/296/407/520/521, 284/295/296, 294/296/407, 294/465, 294/465/515, 294/521, 295/296, 295/296/332/407, 295/296/407, 295/296/407/521, 295/296/521, 295/332/407/465, 295/332/407/521, 295/332/520/521, 295/407, 296, 296/332/407/520, 296/332/407/521, 296/407, 296/520/521, 332/407, 332/407/520/521, 332/407/521, 407, 407/465, 407/520, 465, 465/515, 465/515/517/521, 465/517/521, and 517, wherein the amino acid positions of the polypeptide sequence are numbered with reference to SEQ ID NO: 166.

In some embodiments, the engineered galactose oxidase comprises at least one substitution or substitution set selected from 171C/220E/295E/296V/407Q, 171C/220E/407V, 171C/220M/296V/407V/520A, 171C/220S/243V/407Q/465T, 171C/220S/332Q/407V, 171C/243V/296V/332Q, 171C/295E/332Q, 171C/296V/407V/465T, 171C/332Q, 171C/407V, 171C/407V/520A, 171L/220E/465T/520A, 171L/295E/296V/332Q/465T, 171L/296V/407I, 173S, 173S/192Q/243A/465G, 173S/465G, 192Q/294S/465G/515V, 192T/220E/295E/296V/332Q/521G, 192T/220E/295E/520A/521G, 192T/220E/407V, 192T/220M/296V/332Q/520A, 192T/295E/296V, 192T/295G/296V/332Q, 192T/295G/296V/520A/521G, 192T/296V, 198A/294E/296S, 198R/295N, 198R/295S/296S, 204A/243A/465G/517R/521Q, 204S, 220C/465G, 220C/465G/517R, 220E, 220E/243V/295E/296V/332Q/407V/521G, 220E/243V/295G/296V/407V, 220E/243V/407I, 220E/243V/407V/465T, 220E/252V/332Q/407I, 220E/295E/296V/332Q/407V/520A, 220E/295E/296V/465T/520A, 220E/295E/465T/521G, 220E/295G/407V/465T, 220E/296V/407V, 220E/332Q/407Q/465T/521G, 220E/407I, 220E/407V, 220E/407V/520A, 220E/465T/520A, 220M/243V/407V/520A/521G, 220M/295E/332Q, 220M/295E/465T/520A, 220S/243V, 220S/243V/407Q/520A/521G, 220S/295E/296V, 220S/295E/296V/332Q/407Q/521G, 220S/295E/332Q/465T/520A/521G, 220S/295E/407I/521G, 220S/295G/296V/332Q, 220S/295G/296V/332Q/407I/465T/521G, 220S/295G/296V/407V, 220S/295G/407I/520A/521G, 220S/296V, 220S/296V/332Q/407V, 220S/296V/332Q/407V/520A/521G, 220S/296V/465T, 220S/296V/465T/521G, 220S/407I, 221I/227N/243A/465G, 227N, 243A/515V/517R, 243V/295E, 243V/295E/407I, 277T/296V/407I/520A/521G, 284I/295E/296V, 294E/296S/407M, 294S/465G, 294S/465G/515V, 294S/521Q, 295E/296V, 295E/296V/332Q/407I, 295E/296V/407Q, 295E/296V/521G, 295E/332Q/407V/465T, 295E/332Q/407V/521G, 295E/332Q/520A/521G, 295E/407I, 295G/296V/407I/521G, 296S/407M, 296V, 296V/332Q/407V/520A, 296V/332Q/407V/521G, 296V/520A/521G, 332Q/407I, 332Q/407V, 332Q/407V/520A/521G, 332Q/407V/521G, 407I, 407I/520A, 407Q/465T, 407V, 407V/520A, 465G/515V, 465G/515V/517R/521Q, 465G/517H/521Q, 465M, and 517N, wherein the amino acid positions of the polypeptide sequence are numbered with reference to SEQ ID NO: 166. In some embodiments, the engineered galactose oxidase comprises at least one substitution or substitution set selected from V171C/V220E/R295E/F296V/E407Q, V171C/V220E/E407V, V171C/V220M/F296V/E407V/T520A, V171C/V220S/T243V/E407Q/A465T, V171C/V220S/S332Q/E407V, V171C/T243V/F296V/S332Q, V171C/R295E/S332Q, V171C/F296V/E407V/A465T, V171C/S332Q, V171C/E407V, V171C/E407V/T520A, V171L/V220E/A465T/T520A, V171L/R295E/F296V/S332Q/A465T, V171L/F296V/E407I, A173S, A173S/N192Q/T243A/A465G, A173S/A465G, N192Q/G294S/A465G/L515V, N192T/V220E/R295E/F296V/S332Q/T521G, N192T/V220E/R295E/T520A/T521G, N192T/V220E/E407V, N192T/V220M/F296V/S332Q/T520A, N192T/R295E/F296V, N192T/R295G/F296V/S332Q, N192T/R295G/F296V/T520A/T521G, N192T/F296V, S198A/G294E/F296S, S198R/R295N, S198R/R295S/F296S, L204A/T243A/A465G/G517R/T521Q, L204S, V220C/A465G, V220C/A465G/G517R, V220E, V220E/T243V/R295E/F296V/S332Q/E407V/T521G, V220E/T243V/R295G/F296V/E407V, V220E/T243V/E407I, V220E/T243V/E407V/A465T, V220E/S252V/S332Q/E407I, V220E/R295E/F296V/S332Q/E407V/T520A, V220E/R295E/F296V/A465T/T520A, V220E/R295E/A465T/T521G, V220E/R295G/E407V/A465T, V220E/F296V/E407V, V220E/S332Q/E407Q/A465T/T521G, V220E/E407I, V220E/E407V, V220E/E407V/T520A, V220E/A465T/T520A, V220M/T243V/E407V/T520A/T521G, V220M/R295E/S332Q, V220M/R295E/A465T/T520A, V220S/T243V, V220S/T243V/E407Q/T520A/T521G, V220S/R295E/F296V, V220S/R295E/F296V/S332Q/E407Q/T521G, V220S/R295E/S332Q/A465T/T520A/T521G, V220S/R295E/E407I/T521G, V220S/R295G/F296V/S332Q, V220S/R295G/F296V/S332Q/E407I/A465T/T521G, V220S/R295G/F296V/E407V, V220S/R295G/E407I/T520A/T521G, V220S/F296V, V220S/F296V/S332Q/E407V, V220S/F296V/S332Q/E407V/T520A/T521G, V220S/F296V/A465T, V220S/F296V/A465T/T521G, V220S/E407I, T221I/M227N/T243A/A465G, M227N, T243A/L515V/G517R, T243V/R295E, T243V/R295E/E407I, A277T/F296V/E407I/T520A/T521G, V284I/R295E/F296V, G294E/F296S/E407M, G294S/A465G, G294S/A465G/L515V, G294S/T521Q, R295E/F296V, R295E/F296V/S332Q/E407I, R295E/F296V/E407Q, R295E/F296V/T521G, R295E/S332Q/E407V/A465T, R295E/S332Q/E407V/T521G, R295E/S332Q/T520A/T521G, R295E/E407I, R295G/F296V/E407I/T521G, F296S/E407M, F296V, F296V/S332Q/E407V/T520A, F296V/S332Q/E407V/T521G, F296V/T520A/T521G, S332Q/E407I, S332Q/E407V, S332Q/E407V/T520A/T521G, S332Q/E407V/T521G, E407I, E407I/T520A, E407Q/A465T, E407V, E407V/T520A, A465G/L515V, A465G/L515V/G517R/T521Q, A465G/G517H/T521Q, A465M, and G517N, wherein the amino acid positions of the polypeptide sequence are numbered with reference to SEQ ID NO: 166.

In some embodiments, the engineered galactose oxidase comprises a polypeptide sequence that has at least 85%, 86%, 87%, 88%, 89%, 90%, 91%, 92%, 93%, 94%, 95%, 96%, 97%, 98%, 99%, or more sequence identity to SEQ ID NO: 272, and wherein the engineered galactose oxidase comprises at least one substitution or substitution set at one or more positions in the polypeptide sequence selected from 4, 8, 8/29/92/196/258/426, 8/46/92/279/296/426/549/553/597, 8/56/192/194/460/571/598, 8/56/243/560/598, 8/92/258/363/549/553/567, 8/192/194/243/460/553/560, 8/192/460/560/598, 8/258/363/426/553/597, 16, 16/24/43/56/103/220/295/296/499/549, 16/43/56/103/148/220/295/296/499/549, 16/43/63/103/295/304/499/549, 16/43/63/148/295/499, 16/43/103/148/220/295/426/549, 16/43/148/220/295/499, 16/43/295/296/549, 16/43/426/549, 16/56/63/148/295/296/304/426, 16/56/296, 16/56/426/499, 16/63/103/220/295/426/549, 16/103/220/296/465/549, 16/103/220/465, 16/148/220/295/296/304/499, 16/148/220/295/426/499/549, 16/148/220/296/549, 16/148/295/426/549, 16/220/499, 16/295/296/426/499/549, 16/295/426/465/499/549, 24, 24/36, 24/36/43/148/319/560/637, 24/36/92/148, 24/36/92/222/560/637, 24/36/92/279/319/363/637, 24/36/148/222/279/560/637, 24/36/363/465/637, 24/43/92/279/363/560/637, 24/43/92/279/499, 24/43/148/295/560, 24/43/148/363, 24/43/148/560, 24/43/222, 24/92/148/279/363, 24/92/279/363/465/499/560/637, 24/148/319/465/637, 24/148/637, 24/637, 29, 29/46/92/196/258/279/363/426/481/567/597, 36, 36/43/92/148/222/279/295/499/560/637, 36/92/148/279/319/363/560/637, 36/92/148/499/637, 36/92/319/363/637, 36/92/560, 36/148/222/319/465/499, 36/222/279/319/363/560, 43, 43/56/220/296/426/499/549, 43/56/220/426/549, 43/92/148/222/279/499/560, 43/92/222/465/499/637, 43/148/279/295/560, 43/148/549, 43/222/279, 43/295/499, 46, 46/196/228/279/296/465/553, 56, 63, 92, 92/148/295/319/465/637, 92/279/465/637, 103, 134, 148, 148/295/465, 192/243, 194, 196, 196/258/363/426/465/549/597, 220, 220/295/520, 220/295/521, 220/296/304/426/549, 222, 257, 258, 279, 279/560/637, 295, 296, 304, 319, 363, 363/426/481/553, 426, 465, 499, 549, 553, 560, 567, 597, and 637, wherein the amino acid positions of the polypeptide sequence are numbered with reference to SEQ ID NO: 272.

In some embodiments, the engineered galactose oxidase comprises at least one substitution or substitution set selected from 4Q, 8I/29T/92V/196D/258L/426P, 8I/46V/92V/279T/296T/426P/549G/553S/597D, 8I/92V/258L/363E/549G/553S/567M, 8I/258L/363E/426P/553S/597D, 8V, 8V/56I/192Q/194G/460Q/571A/598E, 8V/56I/243S/560T/598E, 8V/192Q/194E/243S/460Q/553S/560T, 8V/192Q/460A/560T/598E, 16E, 16E/43E/426L/549W, 16E/56F/426L/499V, 16E/103I/220E/296E/465F/549W, 16E/103I/220E/465F, 16E/148R/220E/295T/426L/499V/549W, 16E/220E/499V, 16E/295Q/426L/465F/499V/549W, 16S, 16S/24A/43E/56F/103I/220E/295T/296L/499V/549W, 16S/43E/56F/103I/148R/220E/295S/296E/499V/549W, 16S/43E/63V/103I/295Q/304C/499V/549W, 16S/43E/63V/148R/295Q/499V, 16S/43E/103I/148R/220E/295Q/426L/549W, 16S/43E/148R/220E/295S/499V, 16S/43E/295T/296E/549W, 16S/56F/63V/148R/295T/296E/304C/426L, 16S/56F/296E, 16S/63V/103I/220E/295Q/426L/549W, 16S/148R/220E/295Q/296E/304C/499V, 16S/148R/220E/296E/549W, 16S/148R/295Q/426L/549W, 16S/295Q/296E/426L/499V/549W, 24A, 24E, 24P, 24P/36P, 24P/36P/43A/148A/319R/560W/637L, 24P/36P/92D/148A, 24P/36P/92D/222D/560W/637L, 24P/36P/92D/279L/319R/363L/637L, 24P/36P/148A/222D/279L/560W/637L, 24P/36P/363L/465F/637L, 24P/43A/92D/279L/499F, 24P/43A/148A/295E/560W, 24P/43A/148A/363L, 24P/43A/148A/560W, 24P/43A/222D, 24P/43Q/92D/279L/363L/560W/637L, 24P/92D/148A/279L/363L, 24P/92D/279L/363L/465F/499F/560W/637L, 24P/148A/319S/465F/637L, 24P/148A/637L, 24P/637L, 24Q, 29T/46V/92V/196D/258L/279T/363E/426P/481D/567M/597D, 29Y, 36P, 36P/43Q/92D/148A/222D/279L/295D/499F/560W/637L, 36P/92D/148A/279L/319S/363L/560W/637L, 36P/92D/148A/499F/637L, 36P/92D/319R/363L/637L, 36P/92D/560W, 36P/148A/222D/319S/465F/499F, 36P/222D/279L/319S/363L/560W, 43A, 43A/92D/148A/222D/279L/499F/560W, 43A/148A/279L/295D/560W, 43A/222D/279L, 43E/56F/220E/296E/426L/499V/549W, 43E/56F/220E/426L/549W, 43E/148R/549W, 43E/295Q/499V, 43Q, 43Q/92D/222Y/465F/499F/637L, 46V, 46V/196D/228W/279T/296T/465F/553S, 56I, 63V, 92D/148A/295E/319S/465F/637L, 92D/279L/465F/637L, 92V, 103I, 134H, 148A, 148R, 148R/295Q/465F, 192Q/243S, 194E, 196D, 196D/258L/363E/426P/465F/549G/597D, 220E, 220E/295E/520A, 220E/295E/521G, 220E/296E/304C/426L/549W, 222D, 222T, 222Y, 257D, 258L, 279L/560W/637L, 279T, 295E, 295Q, 295S, 295T, 296E, 296T, 304C, 319S, 363E, 363E/426P/481D/553S, 426A, 426L, 465G, 499F, 499V, 549G, 549Q, 553S, 560W, 567M, 597D, and 637L, wherein the amino acid positions of the polypeptide sequence are numbered with reference to SEQ ID NO: 272. In some embodiments, the engineered galactose oxidase comprises at least one substitution or substitution set selected from A4Q, S8I/N29T/ S92V/E196D/S258L/S426P, S8I/A46V/S92V/M279T/ V296T/S426P/R549G/Q553S/N597D, S8I/S92V/S258L/ S363E/R549G/Q553S/S567M, S8I/S258L/S363E/S426P/ Q553S/N597D, S8V, S8V/Y56I/N192Q/A194G/R460Q/ K571A/N598E, S8V/Y56I/T243S/R560T/N598E, S8V/ N192Q/A194E/T243S/R460Q/Q553S/R560T, S8V/N192Q/ R460A/R560T/N598E, A16E, A16E/F43E/S426L/R549W, A16E/Y56F/S426L/I499V, A16E/S103I/S220E/V296E/ T465F/R549W, A16E/S103I/S220E/T465F, A16E/Q148R/ S220E/R295T/S426L/I499V/R549W, A16E/S220E/I499V, A16E/R295Q/S426L/T465F/I499V/R549W, A16S, A16S/ S24A/F43E/Y56F/S103I/S220E/R295T/V296L/I499V/ R549W, A16S/F43E/Y56F/S103I/Q148R/S220E/R295S/ V296E/I499V/R549W, A16S/F43E/T63V/S103I/R295Q/ S304C/I499V/R549W, A16S/F43E/T63V/Q148R/R295Q/ I499V, A16S/F43E/S103I/Q148R/S220E/R295Q/S426L/ R549W, A16S/F43E/Q148R/S220E/R295S/I499V, A16S/ F43E/R295T/V296E/R549W, A16S/Y56F/T63V/Q148R/ R295T/V296E/S304C/S426L, A16S/Y56F/V296E, A16S/ T63V/S103I/S220E/R295Q/S426L/R549W, A16S/Q148R/ S220E/R295Q/V296E/S304C/I499V, A16S/Q148R/S220E/ V296E/R549W, A16S/Q148R/R295Q/S426L/R549W, A16S/R295Q/V296E/S426L/I499V/R549W, S24A, S24E, S24P, S24P/K36P, S24P/K36P/F43A/Q148A/N319R/ R560W/R637L, S24P/K36P/S92D/Q148A, S24P/K36P/ S92D/V222D/R560W/R637L, S24P/K36P/S92D/M279L/ N319R/S363L/R637L, S24P/K36P/Q148A/V222D/ M279L/R560W/R637L, S24P/K36P/S363L/T465F/R637L, S24P/F43A/S92D/M279L/I499F, S24P/F43A/Q148A/ R295E/R560W, S24P/F43A/Q148A/S363L, S24P/F43A/ Q148A/R560W, S24P/F43A/V222D, S24P/F43Q/S92D/ M279L/S363L/R560W/R637L, S24P/S92D/Q148A/ M279L/S363L, S24P/S92D/M279L/S363L/T465F/I499F/ R560W/R637L, S24P/Q148A/N319S/T465F/R637L, S24P/ Q148A/R637L, S24P/R637L, S24Q, N29T/A46V/S92V/ E196D/S258L/M279T/S363E/S426P/Q481D/S567M/ N597D, N29Y, K36P, K36P/F43Q/S92D/Q148A/V222D/ M279L/R295D/I499F/R560W/R637L, K36P/S92D/ Q148A/M279L/N319S/S363L/R560W/R637L, K36P/ S92D/Q148A/I499F/R637L, K36P/S92D/N319R/S363L/ R637L, K36P/S92D/R560W, K36P/Q148A/V222D/N319S/ T465F/I499F, K36P/V222D/M279L/N319S/S363L/ R560W, F43A, F43A/S92D/Q148A/V222D/M279L/I499F/ R560W, F43A/Q148A/M279L/R295D/R560W, F43A/ V222D/M279L, F43E/Y56F/S220E/V296E/S426L/I499V/ R549W, F43E/Y56F/S220E/S426L/R549W, F43E/Q148R/ R549W, F43E/R295Q/I499V, F43Q, F43Q/S92D/V222Y/ T465F/I499F/R637L, A46V, A46V/E196D/F228W/M279T/ V296T/T465F/Q553S, Y56I, T63V, S92D/Q148A/R295E/ N319S/T465F/R637L, S92D/M279L/T465F/R637L, S92V, S103I, N134H, Q148A, Q148R, Q148R/R295Q/T465F, N192Q/T243S, A194E, E196D, E196D/S258L/S363E/ S426P/T465F/R549G/N597D, S220E, S220E/R295E/ T520A, S220E/R295E/T521G, S220E/V296E/S304C/ S426L/R549W, V222D, V222T, V222Y, S257D, S258L, M279L/R560W/R637L, M279T, R295E, R295Q, R295S, R295T, V296E, V296T, S304C, N319S, S363E, S363E/ S426P/Q481D/Q553S, S426A, S426L, T465G, I499F, I499V, R549G, R549Q, Q553S, R560W, S567M, N597D, and R637L, wherein the amino acid positions of the polypeptide sequence are numbered with reference to SEQ ID NO: 272.

In some additional embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 272, and wherein the engineered galactose oxidase comprises at least one substitution or substitution set at one or more positions in the polypeptide sequence selected from 4/8/56/598, 4/56/192/194/257/571/598, 4/56/ 194/329/598, 4/194/243/549/598, 8/29/46/196/363/481/ 549/553, 8/56, 8/56/192/194/243/329, 8/56/192/194/243/ 329/460/560, 8/56/192/194/243/460/560/598, 8/56/192/ 243/460, 8/56/192/243/598, 8/56/194/257/460/549/560/598, 8/92/196/258/426/597, 8/92/196/481/597, 8/192/194/243/ 329/460/560, 8/196/258/279/481/549/553, 8/243/460/560/ 571/598, 8/257/460/560/598, 8/258/363/426/549, 8/279/ 363/426/481/549/553, 16/43/63/103/295/296/499, 16/43/ 103/148/295/426/499/549, 16/43/103/304/499/549, 16/43/ 148/295/296/304/499/549, 16/43/148/296/426/499, 16/43/ 295/296/499, 16/56/103/220/295, 16/56/103/220/295/296, 16/56/103/295/549, 16/56/148/295/296/304/426/549, 16/56/220/295, 16/56/220/499/549, 16/56/295, 16/56/295/ 296/549, 16/56/295/499, 16/56/499/549, 16/63/103/148/ 426/499/549, 16/63/103/426/499/549, 16/63/148/220/295/ 296/426/499, 16/63/148/499/549, 16/103, 16/103/148, 16/103/148/220/499, 16/103/148/295/426/499/549, 16/103/ 220/295, 16/148/220/295/426/499, 16/148/295/426, 16/148/ 295/549, 16/148/426/549, 16/220/295/296, 16/304/426/499, 16/304/499/549, 24/36/92/279/295/363/499, 24/43/92/148/ 279/295/319/637, 24/43/92/222/279, 24/43/222/319, 24/43/ 363/637, 24/92, 24/92/148/279, 24/92/222/279/319/637, 24/222/637, 24/279/319, 29/46/92/196/426/481/549/597, 29/46/481/549/553/597, 29/426/549, 29/549/553, 36/43/ 222/279/363/560, 36/92/148/222/279/319/363/499/560/ 637, 36/92/222/637, 36/148/279/319/499, 43/148/222/279/ 560/637, 43/220/295/549, 56/148/220/295/499, 56/194/243/ 257/329/460, 56/243, 63/103/148/220/295/549, 63/220/295/ 304/426/499/549, 63/220/295/304/549, 92, 92/222/279/499/ 560/637, 92/258/363/426/481/549/597, 103/295/499/549, 148/220/304, 148/222, 148/222/560/637, 148/279/319/499, 194/243/329/460, 194/243/329/560/571/598, 220/295/549, 279/296/481/549/553/567/597, 279/560/637, 295/296/426/ 549, 295/296/549, 295/499/560/637, 296/363/426/481/549, 319/560, 319/637, and 363/560, wherein the amino acid positions of the polypeptide sequence are numbered with reference to SEQ ID NO: 272. In some embodiments, the engineered galactose oxidase comprises at least one substitution or substitution set selected from 4Q/8V/56I/598L, 4Q/56I/192Q/194G/257N/571A/598E, 4Q/56I/194E/329A/ 598E, 4Q/194G/243S/549G/598E, 8I/29Y/46V/196D/363E/ 481D/549G/553S, 8I/92V/196D/258L/426P/597D, 8I/92V/ 196D/481D/597D, 8I/196D/258L/279T/481D/549G/553S, 8I/258L/363E/426P/549G, 8I/279T/363E/426P/481D/ 549G/553S, 8V/56I, 8V/56I/192Q/194E/243S/329A/460A/ 560T, 8V/56I/192Q/194E/243S/460A/560T/598E, 8V/56I/ 192Q/194G/243S/329A, 8V/56I/192Q/243S/460Q, 8V/56I/ 192Q/243S/598E, 8V/56I/194G/257D/460A/549G/560T/ 598L, 8V/192Q/194G/243S/329A/460Q/560T, 8V/243S/ 460Q/560T/571A/598L, 8V/257D/460Q/560T/598E, 16E/ 43E/103I/148R/295Q/426L/499V/549W, 16E/43E/103I/ 304C/499V/549W, 16E/43E/295T/296E/499V, 16E/56F/ 103I/220E/295T/296E, 16E/56F/103I/295T/549W, 16E/ 56F/148R/295Q/296E/304C/426L/549W, 16E/56F/295Q/ 296E/549W, 16E/63V/148R/220E/295Q/296E/426L/499V, 16E/103I/220E/295Q, 16E/148R/220E/295S/426L/499V, 16E/148R/295Q/426L, 16E/148R/295Q/549W, 16E/148R/ 426L/549W, 16E/220E/295Q/296E, 16E/304C/499V/549W, 16S/43E/63V/103I/295Q/296E/499V, 16S/43E/148R/295Q/ 296E/304C/499V/549W, 16S/43E/148R/296E/426L/499V, 16S/56F/103I/220E/295S, 16S/56F/220E/295S, 16S/56F/ 220E/499V/549W, 16S/56F/295Q, 16S/56F/295T/499V, 16S/56F/499V/549W, 16S/63V/103I/148R/426L/499V/

549W, 16S/63V/103I/426L/499V/549W, 16S/63V/148R/ 499V/549W, 16S/103I, 16S/103I/148R, 16S/103I/148R/ 220E/499V, 16S/103I/148R/295S/426L/499V/549W, 16S/ 304C/426L/499V, 24P/36P/92D/279L/295E/363L/499F, 24P/43A/92D/148A/279L/295D/319S/637L, 24P/43A/92D/ 222Y/279L, 24P/43A/222Y/319R, 24P/43A/363L/637L, 24P/92D, 24P/92D/148A/279L, 24P/92D/222D/279L/319S/ 637L, 24P/222D/637L, 24P/279L/319R, 29T/46V/92V/ 196D/426P/481D/549G/597D, 29T/46V/481D/549G/553S/ 597D, 29T/549G/553S, 29Y/426P/549G, 36P/43Q/222Y/ 279L/363L/560W, 36P/92D/148A/222D/279L/319S/363L/ 499F/560W/637L, 36P/92D/222D/637L, 36P/148A/279L/ 319S/499F, 43E/220E/295S/549W, 43Q/148A/222D/279L/ 560W/637L, 56F/148R/220E/295Q/499V, 56I/194G/243S/ 257N/329A/460A, 56I/243S, 63V/103I/148R/220E/295S/ 549W, 63V/220E/295T/304C/426L/499V/549W, 63V/ 220E/295T/304C/549W, 92D, 92D/222D/279L/499F/ 560W/637L, 92V/258L/363E/426P/481D/549G/597D, 103I/295T/499V/549W, 148A/222D, 148A/222D/560W/ 637L, 148A/279L/319S/499F, 148R/220E/304C, 194E/ 243S/329A/560T/571A/598E, 194G/243S/329A/460Q, 220E/295T/549W, 279L/560W/637L, 279T/296T/481D/ 549G/553S/567M/597D, 295D/499F/560W/637L, 295 Q/296F/426L/549W, 295S/296E/549W, 296T/363E/426P/ 481D/549G, 319R/637L, 319S/560W, and 363L/560W, wherein the amino acid positions of the polypeptide sequence are numbered with reference to SEQ ID NO: 272. In some embodiments, the engineered galactose oxidase comprises at least one substitution or substitution set selected from A4Q/S8V/Y56I/N598L, A4Q/Y56I/N192Q/ A194G/S257N/K571A/N598E, A4Q/Y56I/A194E/L329A/ N598E, A4Q/A194G/T243S/R549G/N598E, S8I/N29Y/ A46V/E196D/S363E/Q481D/R549G/Q553S, S8I/S92V/ E196D/S258L/S426P/N597D, S8I/S92V/E196D/Q481D/ N597D, S8I/E196D/S258L/M279T/Q481D/R549G/Q553S, S8I/S258L/S363E/S426P/R549G, S8I/M279T/S363E/ S426P/Q481D/R549G/Q553S, S8V/Y56I, S8V/Y56I/ N192Q/A194E/T243S/L329A/R460A/R560T, S8V/Y56I/ N192Q/A194E/T243S/R460A/R560T/N598E, S8V/Y56I/ N192Q/A194G/T243S/L329A, S8V/Y56I/N192Q/T243S/ R460Q, S8V/Y56I/N192Q/T243S/N598E, S8V/Y56I/ A194G/S257D/R460A/R549G/R560T/N598L, S8V/ N192Q/A194G/T243S/L329A/R460Q/R560T, S8V/T243S/ R460Q/R560T/K571A/N598L, S8V/S257D/R460Q/ R560T/N598E, A16E/F43E/S103I/Q148R/R295Q/S426L/ I499V/R549W, A16E/F43E/S103I/S304C/I499V/R549W, A16E/F43E/R295T/V296E/I499V, A16E/Y56F/S103I/ S220E/R295T/V296E, A16E/Y56F/S103I/R295T/R549W, A16E/Y56F/Q148R/R295Q/V296E/S304C/S426L/R549W, A16E/Y56F/R295Q/V296E/R549W, A16E/T63V/Q148R/ S220E/R295Q/V296E/S426L/I499V, A16E/S103I/S220E/ R295Q, A16E/Q148R/S220E/R295S/S426L/I499V, A16E/ Q148R/R295Q/S426L, A16E/Q148R/R295Q/R549W, A16E/Q148R/S426L/R549W, A16E/S220E/R295Q/V296E, A16E/S304C/I499V/R549W, A16S/F43E/T63V/S103I/ R295Q/V296E/I499V, A16S/F43E/Q148R/R295Q/V296E/ S304C/I499V/R549W, A16S/F43E/Q148R/V296E/S426L/ I499V, A16S/Y56F/S103I/S220E/R295S, A16S/Y56F/ S220E/R295S, A16S/Y56F/S220E/I499V/R549W, A16S/ Y56F/R295Q, A16S/Y56F/R295T/I499V, A16S/Y56F/ I499V/R549W, A16S/T63V/S103I/Q148R/S426L/I499V/ R549W, A16S/T63V/S103I/S426L/I499V/R549W, A16S/ T63V/Q148R/I499V/R549W, A16S/S103I, A16S/S103I/ Q148R, A16S/S103I/Q148R/S220E/I499V, A16S/S103I/ Q148R/R295S/S426L/I499V/R549W, A16S/S304C/S426L/ I499V, S24P/K36P/S92D/M279L/R295E/S363L/I499F, S24P/F43A/S92D/Q148A/M279L/R295D/N319S/R637L, S24P/F43A/S92D/V222Y/M279L, S24P/F43A/V222Y/ N319R, S24P/F43A/S363L/R637L, S24P/S92D, S24P/ S92D/Q148A/M279L, S24P/S92D/V222D/M279L/N319S/ R637L, S24P/V222D/R637L, S24P/M279L/N319R, N29T/ A46V/S92V/E196D/S426P/Q481D/R549G/N597D, N29T/ A46V/Q481D/R549G/Q553S/N597D, N29T/R549G/ Q553S, N29Y/S426P/R549G, K36P/F43Q/V222Y/M279L/ S363L/R560W, K36P/S92D/Q148A/V222D/M279L/ N319S/S363L/I499F/R560W/R637L, K36P/S92D/V222D/ R637L, K36P/Q148A/M279L/N319S/I499F, F43E/S220E/ R295S/R549W, F43Q/Q148A/V222D/M279L/R560W/ R637L, Y56F/Q148R/S220E/R295Q/I499V, Y56I/A194G/ T243S/S257N/L329A/R460A, Y56I/T243S, T63V/S103I/ Q148R/S220E/R295S/R549W, T63V/S220E/R295T/ S304C/S426L/I499V/R549W, T63V/S220E/R295T/S304C/ R549W, S92D, S92D/V222D/M279L/I499F/R560W/ R637L, S92V/S258L/S363E/S426P/Q481D/R549G/ N597D, S103I/R295T/I499V/R549W, Q148A/V222D, Q148A/V222D/R560W/R637L, Q148A/M279L/N319S/ I499F, Q148R/S220E/S304C, A194E/T243S/L329A/ R560T/K571A/N598E, A194G/T243S/L329A/R460Q, S220E/R295T/R549W, M279L/R560W/R637L, M279T/ V296T/Q481D/R549G/Q553S/S567M/N597D, R295D/ I499F/R560W/R637L, R295Q/V296E/S426L/R549W, R295S/V296E/R549W, V296T/S363E/S426P/Q481D/ R549G, N319R/R637L, N319S/R560W, and S363L/ R560W, wherein the amino acid positions of the polypeptide sequence are numbered with reference to SEQ ID NO: 272.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 928, and wherein the engineered galactose oxidase comprises at least one substitution or substitution set at one or more positions in the polypeptide sequence selected from 4/43/46/56/63/279/295/319/567/598, 4/43/46/295/319/549/ 560, 4/43/46/426/549/560, 4/43/148/196/279/319/363/560, 16, 16/24/29, 16/24/29/92/220/279/597/598, 16/24/29/279/ 549, 16/24/29/279/637, 16/24/43/92/549, 16/24/43/192/220/ 279/549, 16/29/36/192/319/549/597/598/637, 16/29/36/ 279/549, 16/29/43/92/192/319, 16/29/43/192/222/319/549/ 637, 16/29/43/222/279/549, 16/29/92/192/549/637, 16/29/ 92/220/222/319/549/598, 16/29/92/279/549, 16/29/92/319/ 549, 16/29/92/549/637, 16/29/192/220/549, 16/29/192/220/ 549/597, 16/29/192/222/279/549, 16/29/192/222/637, 16/29/192/549, 16/29/220/222/279/549/637, 16/29/220/ 222/597/598, 16/29/222/549/598/637, 16/29/549/637, 16/36/43/192/597/637, 16/36/92/220/222/279/549, 16/36/ 192/549/597/598/637, 16/36/319/549/597/598/637, 16/43/ 56/192/549/597/598/637, 16/43/92/222/597/598, 16/43/ 192/549, 16/43/220/549/637, 16/43/279/319/597, 16/43/ 279/549/597, 16/43/319/549/598, 16/43/597, 16/92/192/ 279/319/549/637, 16/92/192/279/637, 16/92/220/549, 16/92/319/597/637, 16/192/319/549/637, 16/192/549, 16/220/222/279/549/598/637, 16/220/279/549, 16/220/319/ 549/597/598, 16/222/319/597/598, 16/222/637, 16/279/319/ 549/597/637, 16/279/549/597/598/637, 16/279/597, 16/319/ 597, 16/319/597/598, 16/549, 16/549/598, 16/597, 29/63/ 134/520/597/598, 29/63/520/537/538/598, 29/134/237/537/ 538/567/571, 29/237/520, 29/237/520/538, 29/237/567/598, 29/237/597, 29/597/598, 36/92/549, 36/134/237/520/537/ 538/571, 36/134/237/567/571/597/598, 36/520/537/538/ 597, 43/46/56/148/258/279/363/549/571, 43/46/63/258/ 295/426/560/567/571, 43/46/196/319/549/560/567, 43/279/ 549/560/567, 46/295/319/426, 46/560, 95, 134/237/520/ 597, 134/520/597/598, 220/222/597/637, 220/296/407/465, 224, 237/520, 237/520/537/538/598, 237/520/537/598, 237/

520/538/597, 237/520/567/571/597, 237/520/597/598, 237/538/597/598, 237/571, 237/597/598, 279/319/560, 294, 295/549/560, 343, 433, 465, 483, 486, 520/571/598, 520/597/598, 549/598, 556, 564, 567/571/597, 568, and 609, wherein the amino acid positions of the polypeptide sequence are numbered with reference to SEQ ID NO: 928. In some embodiments, the engineered galactose oxidase comprises at least one substitution or substitution set selected from 4Q/43Q/46V/56F/63V/279L/295T/319S/567M/598E, 4Q/43Q/46V/295Q/319S/549G/560W, 4Q/43Q/46V/426L/549G/560W, 4Q/43Q/148A/196D/279L/319S/363L/560W, 16E, 16E/24P/29T/92D/220E/279T/597D/598L, 16E/24P/29T/279T/549W, 16E/24P/29T/279T/637L, 16E/24P/29Y, 16E/24P/43E/92D/549W, 16E/24P/43E/192N/220E/279T/549W, 16E/29T/36P/192N/319R/549W/597D/598L/637L, 16E/29T/36P/279T/549W, 16E/29T/43A/92D/192N/319R, 16E/29T/43E/222D/279T/549W, 16E/29T/92D/220E/222D/319R/549W/598L, 16E/29T/92D/279T/549W, 16E/29T/192N/220E/549W, 16E/29T/192N/220E/549W/597D, 16E/29T/192N/222D/637L, 16E/29T/192N/549W, 16E/29T/220E/222D/279T/549W/637L, 16E/29T/222D/549W/598L/637L, 16E/29Y/43E/192N/222D/319R/549W/637L, 16E/29Y/92D/319R/549W, 16E/29Y/192N/222D/279T/549W, 16E/29Y/192N/549W, 16E/29Y/220E/222D/597D/598L, 16E/29Y/549W/637L, 16E/36P/43A/192N/597D/637L, 16E/36P/92D/220E/222D/279T/549W, 16E/36P/192N/549W/597D/598L/637L, 16E/36P/319R/549W/597D/598L/637L, 16E/43A/92D/222D/597D/598L, 16E/43A/220E/549W/637L, 16E/43A/279T/549W/597D, 16E/43E/56V/192N/549W/597D/598L/637L, 16E/43E/192N/549W, 16E/43E/279T/319R/597D, 16E/43E/597D, 16E/92D/192N/279T/319R/549W/637L, 16E/92D/220E/549W, 16E/192N/319R/549W/637L, 16E/192N/549W, 16E/220E/222D/279T/549W/598L/637L, 16E/220E/279T/549W, 16E/220E/319R/549W/597D/598L, 16E/222D/319R/597D/598L, 16E/222D/637L, 16E/279T/319R/549W/597D/637L, 16E/279T/597D, 16E/319R/597D, 16E/319R/597D/598L, 16E/549W, 16E/549W/598L, 16E/597D, 16S/29T/92D/549W/637L, 16S/29Y/92D/192N/549W/637L, 16S/43E/319R/549W/598L, 16S/92D/192N/279T/637L, 16S/92D/319R/597D/637L, 16S/279T/549W/597D/598L/637L, 29H/63V/134A/520A/597D/598E, 29H/63V/520A/537G/538D/598E, 29H/134A/237D/537G/538D/567M/571A, 29H/237D/520A, 29H/237D/520A/538D, 29H/237D/567M/598E, 29H/237D/597D, 29H/597D/598E, 36P/92D/549W, 36V/134A/237D/520A/537G/538D/571A, 36V/134A/237D/567M/571A/597D/598E, 36V/520A/537G/538D/597D, 43Q/46V/56F/148A/258L/279L/363L/549G/571A, 43Q/46V/63V/258L/295Q/426L/560W/567M/571A, 43Q/46V/196D/319S/549G/560W/567M, 43Q/279L/549G/560W/567M, 46V/295T/319S/426L, 46V/560W, 95E, 134A/237D/520A/597D, 134A/520A/597D/598E, 220E/222D/597D/637L, 220E/296S/407I/465G, 224D, 237D/520A, 237D/520A/537G/538D/598E, 237D/520A/537G/598E, 237D/520A/538D/597D, 237D/520A/567M/571A/597D, 237D/520A/597D/598E, 237D/538D/597D/598E, 237D/571A, 237D/597D/598E, 279L/319S/560W, 294E, 295Q/549G/560W, 343G, 433G, 465G, 483R, 486P, 520A/571A/598E, 520A/597D/598E, 549G/598E, 556A, 556S, 556V, 564D, 564E, 564T, 564W, 567M/571A/597D, 568E, 568P, and 609D, wherein the amino acid positions of the polypeptide sequence are numbered with reference to SEQ ID NO: 928. In some embodiments, the engineered galactose oxidase comprises at least one substitution or substitution set selected from A4Q/F43Q/A46V/I56F/T63V/M279L/R295T/N319S/S567M/N598E, A4Q/F43Q/A46V/R295Q/N319S/R549G/R560W, A4Q/F43Q/A46V/S426L/R549G/R560W, A4Q/F43Q/Q148A/E196D/M279L/N319S/S363L/R560W, A16E, A16E/S24P/N29T/S92D/S220E/M279T/N597D/N598L, A16E/S24P/N29T/M279T/R549W, A16E/S24P/N29T/M279T/R637L, A16E/S24P/N29Y, A16E/S24P/F43E/S92D/R549W, A16E/S24P/F43E/Q192N/S220E/M279T/R549W, A16E/N29T/K36P/Q192N/N319R/R549W/N597D/N598L/R637L, A16E/N29T/K36P/M279T/R549W, A16E/N29T/F43A/S92D/Q192N/N319R, A16E/N29T/F43E/V222D/M279T/R549W, A16E/N29T/S92D/S220E/V222D/N319R/R549W/N598L, A16E/N29T/S92D/M279T/R549W, A16E/N29T/Q192N/S220E/R549W, A16E/N29T/Q192N/S220E/R549W/N597D, A16E/N29T/Q192N/V222D/R637L, A16E/N29T/Q192N/R549W, A16E/N29T/S220E/V222D/M279T/R549W/R637L, A16E/N29T/V222D/R549W/N598L/R637L, A16E/N29Y/F43E/Q192N/V222D/N319R/R549W/R637L, A16E/N29Y/S92D/N319R/R549W, A16E/N29Y/Q192N/V222D/M279T/R549W, A16E/N29Y/Q192N/R549W, A16E/N29Y/S220E/V222D/N597D/N598L, A16E/N29Y/R549W/R637L, A16E/K36P/F43A/Q192N/N597D/R637L, A16E/K36P/S92D/S220E/V222D/M279T/R549W, A16E/K36P/Q192N/R549W/N597D/N598L/R637L, A16E/K36P/N319R/R549W/N597D/N598L/R637L, A16E/F43A/S92D/V222D/N597D/N598L, A16E/F43A/S220E/R549W/R637L, A16E/F43A/M279T/R549W/N597D, A16E/F43E/I56V/Q192N/R549W/N597D/N598L/R637L, A16E/F43E/Q192N/R549W, A16E/F43E/M279T/N319R/N597D, A16E/F43E/N597D, A16E/S92D/Q192N/M279T/N319R/R549W/R637L, A16E/S92D/S220E/R549W, A16E/Q192N/N319R/R549W/R637L, A16E/Q192N/R549W, A16E/S220E/V222D/M279T/R549W/N598L/R637L, A16E/S220E/M279T/R549W, A16E/S220E/N319R/R549W/N597D/N598L, A16E/V222D/N319R/N597D/N598L, A16E/V222D/R637L, A16E/M279T/N319R/R549W/N597D/R637L, A16E/M279T/N597D, A16E/N319R/N597D, A16E/N319R/N597D/N598L, A16E/R549W, A16E/R549W/N598L, A16E/N597D, A16S/N29T/S92D/R549W/R637L, A16S/N29Y/S92D/Q192N/R549W/R637L, A16S/F43E/N319R/R549W/N598L, A16S/S92D/Q192N/M279T/R637L, A16S/S92D/N319R/N597D/R637L, A16S/M279T/R549W/N597D/N598L/R637L, N29H/T63V/N134A/T520A/N597D/N598E, N29H/T63V/T520A/S537G/N538D/N598E, N29H/N134A/N237D/S537G/N538D/S567M/K571A, N29H/N237D/T520A, N29H/N237D/T520A/N538D, N29H/N237D/S567M/N598E, N29H/N237D/N597D, N29H/N597D/N598E, K36P/S92D/R549W, K36V/N134A/N237D/T520A/S537G/N538D/K571A, K36V/N134A/N237D/S567M/K571A/N597D/N598E, K36V/T520A/S537G/N538D/N597D, F43Q/A46V/I56F/Q148A/S258L/M279L/S363L/R549G/K571A, F43Q/A46V/T63V/S258L/R295Q/S426L/R560W/S567M/K571A, F43Q/A46V/E196D/N319S/R549G/R560W/S567M, F43Q/M279L/R549G/R560W/S567M, A46V/R295T/N319S/S426L, A46V/R560W, T95E, N134A/N237D/T520A/N597D, N134A/T520A/N597D/N598E, S220E/V222D/N597D/R637L, S220E1V296S/E407I/T465G, K224D, N237D/T520A, N237D/T520A/S537G/N538D/N598E, N237D/T520A/S537G/N598E, N237D/T520A/N538D/N597D, N237D/T520A/S567M/K571A/N597D, N237D/T520A/N597D/N598E, N237D/N538D/N597D/N598E, N237D/K571A, N237D/N597D/N598E, M279L/N319S/R560W, G294E, R295Q/R549G/R560W, K343G, S433G, T465G, T483R, K486P, T520A/K571A/N598E, T520A/N597D/N598E, R549G/N598E, K556A, K556S, K556V, S564D, S564E, S564T, S564W, S567M/K571A/N597D, S568E, S568P, and S609D, wherein the amino acid positions of the polypeptide sequence are numbered with reference to SEQ ID NO: 928.

In some additional embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 928, and wherein the engineered galactose oxidase comprises at least one substitution or substitution set at one or more positions in the polypeptide sequence selected from 4/43/46/426/549/560, 36/63/520, 95, 394, 483, 520/597, 556, 562, 568, and 598, wherein the amino acid positions of the polypeptide sequence are numbered with reference to SEQ ID NO: 928. In some embodiments, the engineered galactose oxidase comprises at least one substitution or substitution set selected from 4Q/43Q/46V/ 426L/549G/560W, 36V/63V/520A, 95V, 394A, 483R, 520A/597D, 556V, 562D, 568D, 568P, and 598E, wherein the amino acid positions of the polypeptide sequence are numbered with reference to SEQ ID NO: 928. In some embodiments, the engineered galactose oxidase comprises at least one substitution or substitution set selected from A4Q/ F43Q/A46V/S426L/R549G/R560W, K36V/T63V/T520A, T95V, K394A, T483R, T520A/N597D, K556V, T562D, S568D, S568P, and N598E, wherein the amino acid positions of the polypeptide sequence are numbered with reference to SEQ ID NO: 928

In some additional embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 928, and wherein the engineered galactose oxidase comprises at least one substitution or substitution set at one or more positions in the polypeptide sequence selected from 63/196, 173, 189, 194, 196, 197, 198, 198/ 447, 220/294/296/332, 220/294/465, 290, 292, 294/407/465, 327, 407/465, and 638, wherein the amino acid positions of the polypeptide sequence are numbered with reference to SEQ ID NO: 928. In some embodiments, the engineered galactose oxidase comprises at least one substitution or substitution set selected from 63A/196L, 173S, 173V, 189A, 194R, 194V, 194W, 196A, 196G, 196I, 196L, 196Q, 196R, 196V, 197A, 197E, 197P, 197Q, 197R, 198G, 198T, 198T/ 447I, 220E/294E/296S/332Q, 220M/294E/465G, 290A, 290G, 292G, 294E/407M/465G, 327R, 407V/465G, and 638A, wherein the amino acid positions of the polypeptide sequence are numbered with reference to SEQ ID NO: 928. In some embodiments, the engineered galactose oxidase comprises at least one substitution or substitution set selected from T63A/E196L, A173S, A173V, S189A, A194R, A194V, A194W, E196A, E196G, E196I , E196L, E196Q, E196R, E196V, G197A, G197E, G197P, G197Q, G197R, S198G, S198T, S198T/V447I, S220E/G294E/ V296S/S332Q, S220M/G294E/T465G, S290A, S290G, S292G, G294E/E407M/T465G, Q327R, E407V/T465G, and V638A, wherein the amino acid positions of the polypeptide sequence are numbered with reference to SEQ ID NO: 928.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 932, and wherein the engineered galactose oxidase comprises at least one substitution or substitution set at one or more positions in the polypeptide sequence selected from 16/43/220/258/538/637, 16/258/426/465/538/549/637, 18, 24/222/237/520/538, 24/222/520, 43/222/237/258/426/597, 43/258/407/426/465/538/549/637, 63, 63/95/173/343/564/ 568/609, 95/173/258/426/556/564, 95/173/556/609, 173/ 556, 194, 220/294/295/319/407/426/465/538/549/637, 222/ 237, 222/520/597, 237/258/549/597, 237/265/279, 258/267, 258/319/426/465/549/637, 258/426, and 258/538/549/637, wherein the amino acid positions of the polypeptide sequence are numbered with reference to SEQ ID NO: 932. In some embodiments, the engineered galactose oxidase comprises at least one substitution or substitution set selected from 16E/43A/220M/258S/538D/637L, 16E/258S/ 426S/465G/538D/549W/637L, 18K, 24P/222D/237D/ 520A/538D, 24P/222D/520A, 43A/258S/407I/426S/465G/ 538D/549W/637L, 43E/222D/237D/258S/426S/597D, 63T, 63T/95E/173S/343G/564D/568P/609D, 95E/173S/556V/ 609D, 95V/173S/258S/426S/556V/564W, 173S/556V, 194R, 220M/294E/295S/319S/407I/426S/465G/538D/ 549W/637L, 222D/237D, 222D/520A/597D, 237D/258S/ 549G/597D, 237D/265S/279L, 258S/267T, 258S/319S/ 426S/465G/549W/637L, 258S/426S, and 258S/538D/ 549W/637L, wherein the amino acid positions of the polypeptide sequence are numbered with reference to SEQ ID NO: 932. In some embodiments, the engineered galactose oxidase comprises at least one substitution or substitution set selected from A16E/Q43A/S220M/L258S/N538D/ R637L, A16E/L258S/L426S/T465G/N538D/R549W/ R637L, T18K, S24P/V222D/N237D/T520A/N538D, S24P/ V222D/T520A, Q43A/L258S/E407I/L426S/T465G/ N538D/R549W/R637L, Q43E/V222D/N237D/L258S/ L426S/N597D, V63T, V63T/T95E/A173S/K343G/S564D/ S568P/S609D, T95E/A173S/K556V/S609D, T95V/A173S/ L258S/L426S/K556V/S564W, A173S/K556V, A194R, S220M/G294E/Q295S/N319S/E407I/L426S/T465G/ N538D/R549W/R637L, V222D/N237D, V222D/T520A/ N597D, N237D/L258S/R549G/N597D, N237D/P265S/ M279L, L258S/M267T, L258S/N319S/L426S/T465G/ R549W/R637L, L258S/L426S, and L258S/N538D/R549W/ R637L, wherein the amino acid positions of the polypeptide sequence are numbered with reference to SEQ ID NO: 932.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 1264, and wherein the engineered galactose oxidase comprises at least one substitution or substitution set at one or more positions in the polypeptide sequence selected from 18/95/327/548, 28, 36, 43, 43/46/56/63/191, 43/237/279/ 538/597/598, 43/237/294/538, 43/237/520, 43/237/520/549/ 598, 43/237/520/597, 43/279/294, 43/538, 43/549/597, 51/55/111/150/367/564, 55, 61, 95/327/548, 99, 183, 198, 224, 229, 237/520/538/597, 243, 252, 258, 291, 295, 312, 335, 342, 343, 367/371/564/594, 371, 384, 468, 485, 520, 544, 549, 564/604, 567, 568, 570, 594, 596, 604, 635, and 637, wherein the amino acid positions of the polypeptide sequence are numbered with reference to SEQ ID NO: 1264. In some embodiments, the engineered galactose oxidase comprises at least one substitution or substitution set selected from 18K/95E/327R/548M, 28P, 28S, 36N, 43E, 43E/237D/279L/538D/597D/598E, 43E/237D/294E/538D, 43E/237D/520A, 43E/237D/520A/549G/598E, 43E/237D/ 520A/597D, 43E/279L/294E, 43E/538D, 43E/549G/597D, 43F/46A/56Y/63T/191V, 51P/55W/111Q/150P/367I/564D, 55M, 55R, 61E, 95E/327R/548M, 99H, 183D, 198R, 224G, 229S, 237D/520A/538D/597D, 243K, 243L, 252G, 258H, 291V, 295T, 312T, 335R, 342R, 342S, 343S, 367I/371D/ 564D/594Q, 371A, 371P, 384G, 468N, 485L, 520E, 520N, 544P, 549E, 549G, 564K/604G, 567G, 568A, 570K, 594C, 596G, 604M, 635K, 637N, and 637W, wherein the amino acid positions of the polypeptide sequence are numbered with reference to SEQ ID NO: 1264. In some embodiments, the engineered galactose oxidase comprises at least one substitution or substitution set selected from T18K/V95E/Q327R/T548M, C28P, C28S, K36N, Q43E, Q43E/N237D/M279L/N538D/N597D/N598E, Q43E/N237D/G294E/N538D, Q43E/N237D/T520A, Q43E/N237D/T520A/R549G/N598E, Q43E/N237D/T520A/N597D, Q43E/M279L/G294E, Q43E/N538D, Q43E/R549G/N597D, Q43F/V46A/I56Y/V63T/R191V, K51P/T55W/T111Q/5150P/K367I/W564D, T55M, T55R, K61E, V95E/Q327R/T548M, S99H, R183D, S198R, K224G, C229S, N237D/T520A/N538D/N597D, S243K, S243L, S252G, S258H, F291V, Q295T, S312T, H335R, K342R, K342S, K343S, K367I/K371D/V564D/T594Q, K371A, K371P, C384G, S468N, Y485L, T520E, T520N, R544P, R549E, R549G, W564K/5604G, M567G, S568A, 5570K, T594C, T596G, 5604M, T635K, R637N, and R637W, wherein the amino acid positions of the polypeptide sequence are numbered with reference to SEQ ID NO: 1264.

In some additional embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 1264, and wherein the engineered galactose oxidase comprises at least one substitution or substitution set at one or more positions in the polypeptide sequence selected from 28, 28/99/520/637, 55/295, 55/342, 55/568, 55/568/594, 55/568/637, 61/224/343/520/637, 99/343/637, 99/520/637, 99/637, 224/520/637, 295/342, 295/342/568, 342/568, 342/594, 343/520/637, 403/520/637, 520/637, 568/637, 594, and 637, wherein the amino acid positions of the polypeptide sequence are numbered with reference to SEQ ID NO: 1264. In some embodiments, the engineered galactose oxidase comprises at least one substitution or substitution set selected from 28P, 28P/99H/520E/637N, 55R/295T, 55R/342S, 55R/568A, 55R/568A/594C, 55R/568A/637W, 61E/224G/343S/520E/637N, 99H/343S/637N, 99H/520E/637N, 99H/637N, 224G/520E/637N, 295T/342S, 295T/342S/568A, 342S/568A, 342S/594C, 343S/520E/637N, 403P/520E/637N, 520E/637N, 568A/637W, 594C, and 637W, wherein the amino acid positions of the polypeptide sequence are numbered with reference to SEQ ID NO: 1264. In some embodiments, the engineered galactose oxidase comprises at least one substitution or substitution set selected from C28P, C28P/S99H/T520E/R637N, T55R/Q295T, T55R/K342S, T55R/S568A, T55R/S568A/T594C, T55R/S568A/R637W, K61E/K224G/K343S/T520E/R637N, S99H/K343S/R637N, S99H/T520E/R637N, S99H/R637N, K224G/T520E/R637N, Q295T/K342S, Q295T/K342S/S568A, K342S/S568A, K342S/T594C, K343S/T520E/R637N, S403P/T520E/R637N, T520E/R637N, S568A/R637W, T594C, and R637W, wherein the amino acid positions of the polypeptide sequence are numbered with reference to SEQ ID NO: 1264.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 1416, and wherein the engineered galactose oxidase comprises at least one substitution or substitution set at one or more positions in the polypeptide sequence selected from 13, 13/26/156/274/359/429, 13/156/262/274/315, 13/156/262/315/429/437, 13/156/274/437/568/606, 13/262, 13/262/274/380, 13/262/274/595, 13/262/437/488, 13/274, 13/274/315/437, 13/274/373/437, 13/328/437, 13/373, 13/437, 13/437/541, 26/262/274/315/437, 35, 37, 37/89, 37/89/274, 37/263/274/380/559/561, 37/380, 45, 45/262/274/373/437, 89, 89/263/274/380, 89/263/559, 89/274/380, 105, 154, 156, 156/274/315, 200, 217, 217/274/380/561, 217/274/478, 217/354/380, 217/380, 224, 239, 241, 253, 262, 262/274, 262/274/315, 262/274/437, 262/373/595, 262/380, 262/437, 262/541, 263, 263/274, 263/274/380, 263/354/380/559, 263/380, 263/380/441, 274, 274/328, 274/354, 274/359, 274/373/437, 274/380, 274/380/441, 274/380/559, 274/393/437, 274/437, 274/437/541, 274/437/568, 315, 328, 336, 354, 354/380, 359, 366, 373, 373/595, 375, 380, 380/437, 380/559/561, 393, 429, 437, 438, 439, 441, 478, 478/561, 488, 541, 550, 559, 561, 568, 595, 605, 627, and 641, wherein the amino acid positions of the polypeptide sequence are numbered with reference to SEQ ID NO: 1416. In some embodiments, the engineered galactose oxidase comprises at least one substitution or substitution set selected from 13A/26M/156V/274G/359F/429V, 13A/156L/262V/274G/315G, 13A/156L/274G/437K/568K/606S, 13A/156V/262V/315G/429V/437V, 13A/274G, 13A/274G/315G/437V, 13H, 13K, 13K/262V, 13K/262V/274N/380H, 13K/262V/274N/595W, 13K/262V/437L/488L, 13K/274N/373T/437C, 13K/328R/437C, 13K/373T, 13K/437L, 13K/437L/541R, 26M/262V/274G/315G/437R, 35D, 371, 37M, 37M/89R, 37M/89R/274N, 37V/380K, 37Y, 37Y/263S/274N/380K/559S/561T, 45V, 45V/262V/274N/373T/437C, 89R, 89R/263S/274N/380K, 89R/263S/274N/380R, 89R/263S/559S, 89R/274N/380R, 105R, 154H, 156L, 156V, 156V/274G/315G, 200A, 217P, 217P/274N/380K/561T, 217P/274N/478M, 217P/354T/380K, 217P/380L, 217P/380R, 224W, 239M, 241I, 253V, 262V, 262V/274G/315G, 262V/274G/437R, 262V/274N, 262V/373T/595W, 262V/380H, 262V/437C, 262V/541R, 263S, 263S/274N, 263S/274N/380L, 263S/274N/380R, 263S/354T/380K/559S, 263S/380K, 263S/380K/441I, 274G, 274G/359F, 274G/437V/568K, 274N, 274N/328L, 274N/354T, 274N/373T/437L, 274N/380H, 274N/380K, 274N/380R/441I, 274N/380R/559S, 274N/393P/437L, 274N/437L, 274N/437L/541R, 315G, 328K, 328L, 328R, 336P, 354D, 354T, 354T/380K, 359F, 366T, 373T, 373T/595W, 375L, 380H, 380H/437C, 380K, 380K/559S/561T, 380L, 380R, 393D, 393G, 393P, 393T, 429V, 437C, 437G, 437L, 437R, 437V, 438S, 439G, 441I, 478L, 478M, 478M/561T, 488L, 488T, 541R, 550S, 559S, 561S, 561T, 568K, 595W, 605L, 627R, and 641D, wherein the amino acid positions of the polypeptide sequence are numbered with reference to SEQ ID NO: 1416. In some embodiments, the engineered galactose oxidase comprises at least one substitution or substitution set selected from N13A/N26M/Q156V/Q274G/Y359F/T429V, N13A/Q156L/I262V/Q274G/N315G, N13A/Q156L/Q274G/Y437K/S568K/Q606S, N13A/Q156V/I262V/N315G/T429V/Y437V, N13A/Q274G, N13A/Q274G/N315G/Y437V, N13H, N13K, N13K/I262V, N13K/I262V/Q274N/P380H, N13K/I262V/Q274N/L595W, N13K/I262V/Y437L/N488L, N13K/Q274N/Q373T/Y437C, N13K/G328R/Y437C, N13K/Q373T, N13K/Y437L, N13K/Y437L/L541R, N26M/I262V/Q274G/N315G/Y437R, N35D, D37I, D37M, D37M/Y89R, D37M/Y89R/Q274N, D37V/P380K, D37Y, D37Y/P263S/Q274N/P380K/G559S/1561T, G45V, G45V/I262V/Q274N/Q373T/Y437C, Y89R, Y89R/P263S/Q274N/P380K, Y89R/P263S/Q274N/P380R, Y89R/P263S/G559S, Y89R/Q274N/P380R, S105R, A154H, Q156L, Q156V, Q156V/Q274G/N315G, G200A, D217P, D217P/Q274N/P380K/1561T, D217P/Q274N/V478M, D217P/A354T/P380K, D217P/P380L, D217P/P380R, G224W, Q239M, V241I, L253V, I262V, I262V/Q274G/N315G, I262V/Q274G/Y437R, I262V/Q274N, I262V/Q373T/L595W, I262V/P380H, I262V/Y437C, I262V/L541R, P263S, P263S/Q274N, P263S/Q274N/P380L, P263S/Q274N/

P380R, P263S/A354T/P380K/G559S, P263S/P380K, P263S/P380K/T441I, Q274G, Q274G/Y359F, Q274G/ Y437V/S568K, Q274N, Q274N/G328L, Q274N/A354T, Q274N/Q373T/Y437L, Q274N/P380H, Q274N/P380K, Q274N/P380R/T441I, Q274N/P380R/G559S, Q274N/ V393P/Y437L, Q274N/Y437L, Q274N/Y437L/L541R, N315G, G328K, G328L, G328R, A336P, A354D, A354T, A354T/P380K, Y359F, V366T, Q373T, Q373T/L595W, N375L, P380H, P380H/Y437C, P380K, P380K/G559S/ I561T, P380L, P380R, V393D, V393G, V393P, V393T, T429V, Y437C, Y437G, Y437L, Y437R, Y437V, F438S, A439G, T441I, V478L, V478M, V478M/I561T, N488L, N488T, L541R, T550S, G559S, I561S, I561T, S568K, L595W, F605L, A627R, and G641D, wherein the amino acid positions of the polypeptide sequence are numbered with reference to SEQ ID NO: 1416.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 1598, and wherein the engineered galactose oxidase comprises at least one substitution or substitution set at one or more positions in the polypeptide sequence selected from 13/99/156/262/437/559/641, 13/99/156/380/437, 13/99/ 156/380/437/559/563/641, 13/99/257/262/263/559, 13/99/ 262/263/380/437/563/641, 13/99/263, 13/99/263/380, 13/99/263/380/437, 13/99/263/380/437/641, 13/99/380/ 437/559, 13/99/437/563, 13/99/563/641, 13/156/262/263/ 437/559, 13/156/263/437, 13/156/380, 13/262, 13/262/263, 13/262/263/380/437/559, 13/380/437, 13/380/437/559, 13/437, 13/470/559/563, 29, 30, 43/46/56/63/99/156/262/ 263/403/559/563, 62, 99, 99/156/262, 99/156/262/263/380/ 437/559, 99/156/262/263/437, 99/156/262/263/559, 99/156/ 263/559, 99/156/380, 99/156/380/437, 99/156/437, 99/262/ 263/437/559/641, 99/262/437/559, 99/263/437/563, 99/380/ 437/559/641, 99/380/563, 99/437, 108, 149, 175, 177, 184, 194, 197, 208, 234, 251, 254, 262, 262/263, 262/263/437/ 559, 262/263/559/563, 262/437/641, 263/380, 263/437/559/ 563, 278, 280, 287, 356, 373, 380, 407, 409, 463, 466, 489, 559/641, 565, 569, 592, 596, 601, 610, and 615, wherein the amino acid positions of the polypeptide sequence are numbered with reference to SEQ ID NO: 1598. In some embodiments, the engineered galactose oxidase comprises at least one substitution or substitution set selected from 13K/99H/ 156L/262V/437C/559S/641D, 13K/99H/156L/380K/437C, 13K/99H/156L/380K/437V/559S/563A/641D, 13K/99H/ 257R/262V/263S/559S, 13K/99H/262V/263S/380K/437R/ 563A/641D, 13K/99H/263S, 13K/99H/263S/380K, 13K/ 99H/263S/380K/437V, 13K/99H/263S/380K/437V/641D, 13K/99H/380K/437R/559S, 13K/99H/437V/563A, 13K/ 99H/563A/641D, 13K/156L/262V/263S/437C/559S, 13K/ 156L/263S/437C, 13K/156L/380K, 13K/262V, 13K/262V/ 263S, 13K/262V/263S/380K/437V/559S, 13K/380K/437C, 13K/380K/437V/559S, 13K/437R, 13K/437V, 13K/470L/ 559S/563A, 29V, 30E, 43F/46A/56Y/63T/99H/156L/262V/ 263S/403P/559S/563A, 62D, 62G, 62Q, 99H, 99H/156L/ 262V, 99H/156L/262V/263S/380K/437C/559S, 99H/156L/ 262V/263S/380K/437V/559S, 99H/156L/262V/263S/437C, 99H/156L/262V/263S/559S, 99H/156L/263S/559S, 99H/ 156L/380K, 99H/156L/380K/437V, 99H/156L/437V, 99H/ 262V/263S/437V/559S/641D, 99H/262V/437V/559S, 99H/ 263S/437R/563A, 99H/380K/437C/559S/641D, 99H/380K/ 563A, 99H/437V, 108F, 149N, 149R, 175G, 177L, 184L, 194Q, 197A, 197P, 208F, 208L, 234L, 251V, 254L, 262V, 262V/263S, 262V/263S/437C/559S, 262V/263S/559S/ 563A, 262V/437V/641D, 263S/380K, 263S/437V/559S/ 563A, 278L, 280M, 280N, 287L, 356S, 373D, 373K, 380K, 407Q, 409H, 409R, 463V, 466V, 489I, 489L, 559S/641D, 565S, 569L, 592G, 592K, 596S, 601G, 601L, 610V, and 615I, wherein the amino acid positions of the polypeptide sequence are numbered with reference to SEQ ID NO: 1598. In some embodiments, the engineered galactose oxidase comprises at least one substitution or substitution set selected from N13K/S99H/Q156L/I262V/L437C/G559S/ G641D, N13K/S99H/Q156L/P380K/L437C, N13K/S99H/ Q156L/P380K/L437V/G559S/I563A/G641D, N13K/S99H/ S257R/I262V/P263S/G559S, N13K/S99H/I262V/P263S/ P380K/L437R/I563A/G641D, N13K/S99H/P263S, N13K/ S99H/P263S/P380K, N13K/S99H/P263S/P380K/L437V, N13K/S99H/P263S/P380K/L437V/G641D, N13K/S99H/ P380K/L437R/G559S, N13K/S99H/L437V/I563A, N13K/ S99H/I563A/G641D, N13K/Q156L/I262V/P263S/L437C/ G559S, N13K/Q156L/P263S/L437C, N13K/Q156L/ P380K, N13K/I262V, N13K/I262V/P263S, N13K/I262V/ P263S/P380K/L437V/G559S, N13K/P380K/L437C, N13K/P380K/L437V/G559S, N13K/L437R, N13K/L437V, N13K/P470L/G559S/I563A, N29V, K30E, Q43F/V46A/ I56Y/V63T/S99H/Q156L/I262V/P263S/S403P/G559S/ I563A, T62D, T62G, T62Q, S99H, S99H/Q156L/I262V, S99H/Q156L/I262V/P263S/P380K/L437C/G559S, S99H/ Q156L/I262V/P263S/P380K/L437V/G559S, S99H/Q156L/ I262V/P263S/L437C, S99H/Q156L/I262V/P263S/G559S, S99H/Q156L/P263S/G559S, S99H/Q156L/P380K, S99H/ Q156L/P380K/L437V, S99H/Q156L/L437V, S99H/I262V/ P263S/L437V/G559S/G641D, S99H/I262V/L437V/G559S, S99H/P263S/L437R/I563A, S99H/P380K/L437C/G559S/ G641D, S99H/P380K/I563A, S99H/L437V, A108F, A149N, A149R, A175G, I177L, V184L, A194Q, G197A, G197P, W208F, W208L, M234L, T251V, Y254L, I262V, I262V/ P263S, I262V/P263S/L437C/G559S, I262V/P263S/G559S/ I563A, I262V/L437V/G641D, P263S/P380K, P263S/ L437V/G559S/I563A, T278L, S280M, S280N, I287L, N356S, Q373D, Q373K, P380K, E407Q, S409H, S409R, I463V, E466V, P489I, P489L, G559S/G641D, T565S, I569L, P592G, P592K, T596S, N601G, N601L, D610V, and L615I, wherein the amino acid positions of the polypeptide sequence are numbered with reference to SEQ ID NO: 1598.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 1866, and wherein the engineered galactose oxidase comprises at least one substitution or substitution set at one or more positions in the polypeptide sequence selected from 29/149/463/601, 29/177/197/592, 29/177/463, 29/197/592, 29/463, 62/208/417/615, 62/286/615, 62/373/466, 62/466, 62/466/597, 149, 149/208/615, 149/463, 177/194/197/463/ 565, 177/197/463/565, 177/280/463/594/601, 177/463/565, 177/463/592, 184, 197, 197/280/463, 197/463/592, 197/466/ 569/596, 208/251/259/278, 234, 234/384, 251, 251/399/615, 278, 373/466, 384/569, 399/615, 417/615, 463/565, 466, 546, 569, and 569/597, wherein the amino acid positions of the polypeptide sequence are numbered with reference to SEQ ID NO: 1866. In some embodiments, the engineered galactose oxidase comprises at least one substitution or substitution set selected from 29V/149N/463V/601L, 29V/ 177L/197P/592G, 29V/177L/463V, 29V/197P/592G, 29V/ 463V, 62D/466V, 62D/466V/597A, 62G/208F/417L/615I, 62G/286C/615I, 62Q/373D/466V, 62Q/466V, 62Q/466V/ 597A, 149N/463V, 149R, 149R/208F/615I, 177L/194Q/ 197P/463V/565S, 177L/197P/463V/565S, 177L/280N/ 463V/594M/601L, 177L/463V/565S, 177L/463V/592G, 184L, 197A, 197A/466V/569L/596S, 197P/280N/463V, 197P/463V/592G, 208F/251V/259N/278L, 234L, 234L/

384N, 251V, 251V/399V/615I, 278L, 373D/466V, 384N/
569L, 399V/615I, 417L/615I, 463V/565S, 466V, 546E,
569L, and 569L/597A, wherein the amino acid positions of
the polypeptide sequence are numbered with reference to
SEQ ID NO: 1866. In some embodiments, the engineered
galactose oxidase comprises at least one substitution or
substitution set selected from N29V/A149N/I463V/N601L,
N29V/I177L/G197P/P592G, N29V/I177L/I463V, N29V/
G197P/P592G, N29V/I463V, T62D/E466V, T62D/E466V/
N597A, T62G/W208F/I417L/L615I, T62G/T286C/L615I,
T62Q/Q373D/E466V, T62Q/E466V, T62Q/E466V/N597A,
A149N/I463V, A149R, A149R/W208F/L615I, I177L/
A194Q/G197P/I463V/T565S, I177L/G197P/I463V/T565S,
I177L/5280N/I463V/T594M/N601L, I177L/I463V/T565S,
I177L/I463V/P592G, V184L, G197A, G197A/E466V/
I569L/T596S, G197P/5280N/I463V, G197P/I463V/P592G,
W208F/T251V/D259N/T278L, M234L, M234L/C384N,
T251V, T251V/T399V/L615I, T278L, Q373D/E466V,
C384N/I569L, T399V/L615I, I417L/L615I, I463V/T565S,
E466V, K546E, I569L, and I569L/N597A, wherein the
amino acid positions of the polypeptide sequence are numbered with reference to SEQ ID NO: 1866.

In some embodiments, the engineered galactose oxidase
comprises a polypeptide sequence having at least 85%, 86%,
87%, 88%, 89%, 90%, 91%, 92%, 93%, 94%, 95%, 96%,
97%, 98%, 99%, or more sequence identity to SEQ ID NO:
1912, and wherein the engineered galactose oxidase comprises at least one substitution or substitution set at one or
more positions in the polypeptide sequence selected from 3,
4, 9, 18, 26, 29, 30, 38, 40, 42, 43, 44, 48, 50, 75, 79, 135,
136, 142, 156, 159, 161, 197, 486, and 601, wherein the
amino acid positions of the polypeptide sequence are numbered with reference to SEQ ID NO: 1912. In some embodiments, the engineered galactose oxidase comprises at least
one substitution or substitution set selected from 3K, 4K, 9L,
18S, 26C, 26H, 26T, 29A, 29M, 29T, 29V, 29Y, 30L, 30N,
30R, 38M, 40P, 42F, 43D, 43G, 43P, 43T, 44H, 48C, 48P,
50D, 50H, 50I, 50T, 50V, 75N, 79A, 79P, 79S, 135D, 136A,
136G, 142C, 142G, 142H, 142S, 142V, 156L, 156T, 159G,
159K, 159S, 161Q, 161V, 197D, 197L, 486A, 486I, 486L,
486P, 486R, 486V, and 601L, wherein the amino acid
positions of the polypeptide sequence are numbered with
reference to SEQ ID NO: 1912. In some embodiments, the
engineered galactose oxidase comprises at least one substitution or substitution set selected from S3K, A4K, A9L,
T18S, N26C, N26H, N26T, N29A, N29M, N29T, N29V,
N29Y, K30L, K30N, K30R, T38M, W40P, T42F, Q43D,
Q43G, Q43P, Q43T, Y44H, G48C, G48P, P50D, P50H,
P50I, P50T, P50V, Q75N, Q79A, Q79P, Q79S, G135D,
Q136A, Q136G, A142C, A142G, A142H, A142S, A142V,
Q156L, Q156T, L159G, L159K, L159S, R161Q, R161V,
P197D, P197L, K486A, K486I, K486L, K486P, K486R,
K486V, and N601L, wherein the amino acid positions of the
polypeptide sequence are numbered with reference to SEQ
ID NO: 1912.

In some embodiments, the engineered galactose oxidase
comprises a polypeptide sequence having at least 85%, 86%,
87%, 88%, 89%, 90%, 91%, 92%, 93%, 94%, 95%, 96%,
97%, 98%, 99%, or more sequence identity to SEQ ID NO:
1912, and wherein the engineered galactose oxidase comprises at least one substitution or substitution set at one or
more positions in the polypeptide sequence selected from
29, 29/30/50/79/136/197, 29/30/50/79/197/407, 29/30/79/
136/156/197, 29/30/79/197, 29/30/79/197/407, 29/30/136/
197/407/486, 29/30/136/407, 29/30/197, 29/30/197/407,
29/50/197/407/486, 29/197/407, 29/197/407/486, 30, 30/50/
79/136/156/197, 43/197/407, 50/136/197/486, 65, 79,
79/136/197/407, 79/156/197/407, 136, 136/197/407, 136/
197/486, 156/161/486, 197, 197/407, 197/486, 279/291/375/
420/429/436/453/465, 279/291/375/465/536/538, 279/291/
465, 279/291/465/536, 279/375/420/429/453/465/472/538,
279/375/420/465, 279/465, 291/375/420/430/465/538, 291/
375/436/465/538, 291/375/453/465, 291/420/465/481/538,
291/429/465, 291/453/465/536/538, 291/465, 291/465/538,
375/420/465, 375/429/453/465, 375/465, 420/436/465, 429/
465, 453/465, 453/465/478/481, 465, 465/536/538, 486, and
615, wherein the amino acid positions of the polypeptide
sequence are numbered with reference to SEQ ID NO: 1912.
In some embodiments, the engineered galactose oxidase
comprises at least one substitution or substitution set
selected from 29A, 29A/30N/79E/136G/156C/197D, 29A/
30R/50V/79S/136G/197D, 291, 291/30N/79S/197D, 29I/
30N/79S/197D/407D, 29I/30R/197D/407D, 29S, 29S/30N/
50V/79S/197D/407D, 29S/30R/79S/197D, 29S/30R/79S/
197D/407D, 29S/30R/136G/197D/407D/486S, 29S/30R/
136G/407D, 29S/30R/197D, 29S/50V/197D/407D/486S,
29S/197D/407D, 29S/197D/407D/486S, 29T, 30N/50T/
79S/136G/156C/197D, 30R, 43D/197D/407D, 50V/136G/
197D/486I, 65A, 79S, 79S/136G/197D/407D, 79S/156C/
197D/407D, 136G, 136G/197D/407D, 136G/197D/486I,
156M/161A/486A, 197D, 197D/407D, 197D/486S, 279L/
291Y/375D/420I/429V/436M/453V/465G, 279L/291Y/
375D/465L/536N/538D, 279L/291Y/465L, 279L/291Y/
465L/536N, 279L/375D/420I/429V/453V/465L/472L/
538D, 279L/375D/420I/465G, 279L/465G, 279L/465L,
291Y/375D/420I/430I/465G/538D, 291Y/375D/436M/
465G/538D, 291Y/375D/453V/465L, 291Y/420I/465L/
481T/538D, 291Y/429V/465L, 291Y/453V/465L/536N/
538D, 291Y/465L, 291Y/465L/538D, 375D/420I/465G,
375D/420I/465L, 375D/429V/453V/465G, 375D/465G,
375D/465L, 420I/436M/465L, 429V/465G, 453V/465G,
453V/465G/478F/481T, 453V/465L, 465G, 465G/536N/
538D, 486S, and 615I, wherein the amino acid positions of
the polypeptide sequence are numbered with reference to
SEQ ID NO: 1912. In some embodiments, the engineered
galactose oxidase comprises at least one substitution or
substitution set selected from N29A, N29A/K30N/Q79E/
Q136G/Q156C/P197D, N29A/K30R/P50V/Q79S/Q136G/
P197D, N29I, N291/K30N/Q79S/P197D, N291/K30N/
Q79S/P197D/Q407D, N291/K30R/P197D/Q407D, N29S,
N29S/K30N/P50V/Q79S/P197D/Q407D, N29S/K30R/
Q79S/P197D, N29S/K30R/Q79S/P197D/Q407D, N29S/
K30R/Q136G/P197D/Q407D/K486S, N29S/K30R/Q136G/
Q407D, N29S/K30R/P197D, N29S/P50V/P197D/Q407D/
K486S, N29S/P197D/Q407D, N29S/P197D/Q407D/
K486S, N29T, K30N/P50T/Q79S/Q136G/Q156C/P197D,
K30R, Q43D/P197D/Q407D, P50V/Q136G/P197D/K486I,
N65A, Q79S, Q79S/Q136G/P197D/Q407D, Q79S/Q156C/
P197D/Q407D, Q136G, Q136G/P197D/Q407D, Q136G/
P197D/K486I, Q156M/R161A/K486A, P197D, P197D/
Q407D, P197D/K486S, M279L/F291Y/N375D/L420I/
T429V/L436M/T453V/T465G, M279L/F291Y/N375D/
T465L/D536N/N538D, M279L/F291Y/T465L, M279L/
F291Y/T465L/D536N, M279L/N375D/L420I/T429V/
T453V/T465L/F472L/N538D, M279L/N375D/L420I/
T465G, M279L/T465G, M279L/T465L, F291Y/N375D/
L420I/V430I/T465G/N538D, F291Y/N375D/L436M/
T465G/N538D, F291Y/N375D/T453V/T465L, F291Y/
L420I/T465L/Q481T/N538D, F291Y/T429V/T465L,
F291Y/T453V/T465L/D536N/N538D, F291Y/T465L,
F291Y/T465L/N538D, N375D/L420I/T465G, N375D/
L420I/T465L, N375D/T429V/T453V/T465G, N375D/
T465G, N375D/T465L, L420I/L436M/T465L, T429V/
T465G, T453V/T465G, T453V/T465G/V478F/Q481T, T453V/T465L, T465G, T465G/D536N/N538D, K486S, and L615I, wherein the amino acid positions of the polypeptide sequence are numbered with reference to SEQ ID NO: 1912.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2080, and wherein the engineered galactose oxidase comprises at least one substitution or substitution set at one or more positions in the polypeptide sequence selected from 24, 47, 63, 78, 95, 119, 121, 197, 207, 214, 219, 220, 249, 294, 324, 365, 408, 414, 437, 480, 485, 520, 556, 571, 598, 600, and 626, wherein the amino acid positions of the polypeptide sequence are numbered with reference to SEQ ID NO: 2080. In some embodiments, the engineered galactose oxidase comprises at least one substitution or substitution set selected from 24R, 47D, 47L, 63T, 78L, 95R, 119Q, 121G, 197E, 197G, 197H, 197L, 197M, 197Q, 197R, 197S, 197W, 207Q, 214L, 219V, 220Q, 220R, 249N, 294K, 324G, 365H, 408A, 414L, 437N, 437R, 480L, 485L, 520L, 556S, 571S, 598T, 600D, and 626W, wherein the amino acid positions of the polypeptide sequence are numbered with reference to SEQ ID NO: 2080. In some embodiments, the engineered galactose oxidase comprises at least one substitution or substitution set selected from S24R, N47D, N47L, V63T, N78L, V95R, T119Q, P121G, P197E, P197G, P197H, P197L, P197M, P197Q, P197R, P197S, P197W, S207Q, I214L, T219V, S220Q, S220R, K249N, G294K, A324G, D365H, D408A, N414L, L437N, L437R, E480L, Y485L, E520L, V556S, A571S, N598T, G600D, and S626W, wherein the amino acid positions of the polypeptide sequence are numbered with reference to SEQ ID NO: 2080.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2080, and wherein the engineered galactose oxidase comprises at least one substitution or substitution set at one or more positions in the polypeptide sequence selected from 14/130/257/472, 14/257, 24, 29, 29/136, 29/136/197/436, 29/136/436, 29/136/436/453, 29/197, 29/197/342/436, 29/197/436, 29/197/436/453, 29/197/453, 29/436, 29/436/472, 29/453, 29/472, 43, 63, 95, 119, 130/421, 136, 136/197/436, 136/197/436/453, 136/436, 144, 197, 197/436, 197/436/453, 197/436/472, 197/453, 214, 219, 249, 257, 257/472, 297, 359, 436, 437, 460, 485, 495, 520, 556, 560, 567, and 592, wherein the amino acid positions of the polypeptide sequence are numbered with reference to SEQ ID NO: 2080. In some embodiments, the engineered galactose oxidase comprises at least one substitution or substitution set selected from 14K/257E, 14T/130M/257Q/472L, 14T/257Q, 24Q, 29I, 29I/136G, 29I/136G/197D/436M, 29I/136G/436M, 29I/197D, 29I/197D/342R/436M, 29I/197D/436M, 29I/197D/436M/453T, 29I/197D/453T, 29I/436M, 29S/136G/197D/436M, 29S/136G/436M/453T, 29S/197D, 29S/197D/436M, 29S/197D/436M/453T, 29S/436M, 29S/436M/472L, 29S/453T, 295/472L, 43G, 63E, 63T, 95R, 119M, 130V/421N, 136G, 136G/197D/436M, 136G/197D/436M/453T, 136G/436M, 144V, 197D, 197D/436M, 197D/436M/453T, 197D/436M/472L, 197D/453T, 197E, 197G, 197H, 197L, 197M, 197Q, 197R, 197S, 197W, 214A, 219V, 249N, 257A, 257A/472L, 297T, 359L, 436M, 437G, 437R, 437Y, 460G, 485R, 495T, 520Y, 556S, 560G, 560I, 567S, and 592H, wherein the amino acid positions of the polypeptide sequence are numbered with reference to SEQ ID NO: 2080. In some embodiments, the engineered galactose oxidase comprises at least one substitution or substitution set selected from N14K/S257E, N14T/I130M/S257Q/F472L, N14T/S257Q, S24Q, N29I, N29I/Q136G, N29I/Q136G/P197D/L436M, N29I/Q136G/L436M, N29I/P197D, N29I/P197D/K342R/L436M, N29I/P197D/L436M, N29I/P197D/L436M/V453T, N29I/P197D/V453T, N29I/L436M, N29S/Q136G/P197D/L436M, N29S/Q136G/L436M/V453T, N29S/P197D, N29S/P197D/L436M, N29S/P197D/L436M/V453T, N29S/L436M, N29S/L436M/F472L, N29S/V453T, N29S/F472L, Q43G, V63E, V63T, V95R, T119M, I130V/G421N, Q136G, Q136G/P197D/L436M, Q136G/P197D/L436M/V453T, Q136G/L436M, I144V, P197D, P197D/L436M, P197D/L436M/V453T, P197D/L436M/F472L, P197D/V453T, P197E, P197G, P197H, P197L, P197M, P197Q, P197R, P197S, P197W, I214A, T219V, K249N, S257A, S257A/F472L, E297T, Y359L, L436M, L437G, L437R, L437Y, Q460G, Y485R, A495T, E520Y, V556S, W560G, W560I, M567S, and G592H, wherein the amino acid positions of the polypeptide sequence are numbered with reference to SEQ ID NO: 2080.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2300, and wherein the engineered galactose oxidase comprises at least one substitution or substitution set at one or more positions in the polypeptide sequence selected from 24, 24/51/63/197/359, 24/119/197, 24/197/249/437, 43/197/359, 43/249, 63, 63/67/197/571, 63/67/214/556, 63/119/197, 63/119/197/207/214, 63/119/197/339/341, 63/119/197/556, 63/119/197/556/571, 63/119/556, 63/197, 63/197/207/556, 63/197/207/556/571, 63/197/214/571, 63/197/249/495, 63/197/556/571, 95/197, 95/219/359, 119, 119/197, 119/197/207/571, 119/197/214, 119/197/214/556, 119/197/214/571, 119/197/339, 119/197/556, 119/197/556/571, 119/197/571, 119/207/556/571, 197, 197/207, 197/207/214/471, 197/214, 197/219, 197/339/556/571, 197/556, 197/556/571, 197/571, 214/249/359, 219, and 556, wherein the amino acid positions of the polypeptide sequence are numbered with reference to SEQ ID NO: 2300. In some embodiments, the engineered galactose oxidase comprises at least one substitution or substitution set selected from 24Q, 24Q/51Q/63T/197R/359L, 24Q/119M/197R, 24Q/197Q/249N/437R, 43G/197R/359L, 43G/249N, 63T, 63T/67K/197S/571S, 63T/67K/214A/556G, 63T/119M/197G/556G, 63T/119M/197L/207D/214A, 63T/119M/197L/339V/341R, 63T/119M/197S, 63T/119M/197S/556G/571S, 63T/119M/556G, 63T/197G, 63T/197M/556G/571S, 63T/197R/249N/495T, 63T/197S, 63T/197S/207D/556G, 63T/197S/207D/556G/571S, 63T/197S/214A/571S, 95R/197R, 95R/219V/359L, 119M, 119M/197G/207D/571S, 119M/197G/214A/556G, 119M/197L/214A/556G, 119M/197L/5715, 119M/197M, 119M/197M/214A/571S, 119M/197M/339V, 119M/197M/556G, 119M/197S, 119M/197S/214A, 119M/197S/556G, 119M/197S/556G/571S, 119M/197S/571S, 119M/207D/556G/571S, 197G/207D/214A/47H, 197H/214A, 197L, 197L/207D, 197L/556G, 197M, 197M/214A, 197M/339V/556G/571S, 197M/556G/571S, 197R/219V, 197S, 197S/214A, 197S/219I, 197S/556G, 197S/556G/571S, 197S/571S, 214A/249N/359L, 219V, and 556G, wherein the amino acid positions of the polypeptide sequence are numbered with reference to SEQ ID NO: 2300. In some embodiments, the engineered galactose oxidase comprises at least one substitution or substitution set selected from S24Q, S24Q/K51Q/V63T/D197R/Y359L, S24Q/T119M/D197R, S24Q/D197Q/K249N/L437R, Q43G/D197R/Y359L, Q43G/K249N, V63T, V63T/N67K/D197S/A571S, V63T/N67K/I214A/V556G, V63T/T119M/D197G/V556G, V63T/T119M/

D197L/S207D/I214A, V63T/T119M/D197L/F339V/ W341R, V63T/T119M/D197S, V63T/T119M/D197S/ V556G/A571S, V63T/T119M/V556G, V63T/D197G, V63T/D197M/V556G/A571S, V63T/D197R/K249N/ A495T, V63T/D197S, V63T/D197S/S207D/V556G, V63T/ D197S/S207D/V556G/A571S, V63T/D197S/I214A/ A571S, V95R/D197R, V95R/T219V/Y359L, T119M, T119M/D197G/S207D/A571S, T119M/D197G/I214A/ V556G, T119M/D197L/I214A/V556G, T119M/D197L/ A571S, T119M/D197M, T119M/D197M/I214A/A571S, T119M/D197M/F339V, T119M/D197M/V556G, T119M/ D197S, T119M/D197S/I214A, T119M/D197S/V556G, T119M/D197S/V556G/A571S, T119M/D197S/A571S, T119M/S207D/V556G/A571S, D197G/S207D/I214A/ V471I, D197H/I214A, D197L, D197L/S207D, D197L/ V556G, D197M, D197M/I214A, D197M/F339V/V556G/ A571S, D197M/V556G/A571S, D197R/T219V, D197S, D197S/I214A, D197S/T219I, D197S/V556G, D197S/ V556G/A571S, D197S/A571S, I214A/K249N/Y359L, T219V, and V556G, wherein the amino acid positions of the polypeptide sequence are numbered with reference to SEQ ID NO: 2300.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2300, and wherein the engineered galactose oxidase comprises at least one substitution or substitution set at one or more positions in the polypeptide sequence selected from 194/330/495, 196, 246/408/442/462, 246/442, 292, 327, 327/329, 330, 407, 442, 442/462/515, 462/583, 465, 498, and 583, wherein the amino acid positions of the polypeptide sequence are numbered with reference to SEQ ID NO: 2300. In some embodiments, the engineered galactose oxidase comprises at least one substitution or substitution set selected from 194G/330H/495S, 196Q, 196R, 246Q/408N/ 442Y/462A, 246Q/442Y, 246S/442Y, 292R, 327K, 327R, 327R/329W, 330H, 407K, 407R, 442Y, 442Y/462A/515M, 462A/583A, 465R, 498C, 583G, and 583S, wherein the amino acid positions of the polypeptide sequence are numbered with reference to SEQ ID NO: 2300. In some embodiments, the engineered galactose oxidase comprises at least one substitution or substitution set selected from A194G/ Y330H/A495S, E196Q, E196R, N246Q/D408N/F442Y/ G462A, N246Q/F442Y, N246S/F442Y, S292R, Q327K, Q327R, Q327R/L329W, Y330H, Q407K, Q407R, F442Y, F442Y/G462A/L515M, G462A/T583A, L465R, S498C, T583G, and T583S, wherein the amino acid positions of the polypeptide sequence are numbered with reference to SEQ ID NO: 2300.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2424, and wherein the engineered galactose oxidase comprises at least one substitution or substitution set at one or more positions in the polypeptide sequence selected from 14, 14/24/36/96, 14/24/36/296/424/560, 14/24/78/120/258, 14/24/92/96/99/408, 14/24/96/258/626, 14/24/258/560, 14/78/120/258/488/560/626, 14/92/96/99, 14/92/96/99/120/ 537, 14/92/96/120/376, 14/92/99/120/537, 14/95/120/296/ 480/560, 14/120/480/626, 14/258, 14/258/296/560, 14/376/ 560, 14/408, 23/36/92/95/96, 23/36/92/95/99/408/596, 23/36/408/428, 23/36/537/596, 23/218/537, 23/408/596, 24, 24/36/46/99/426/532/549, 24/36/95/96, 24/36/95/99/404/ 426/485, 24/36/96/99/532/549, 24/36/99/404/426/532/549/ 600, 24/36/120/296/480/560, 24/36/404/426/532, 24/36/ 404/480/485/532/560/600, 24/46/92/404/426/532, 24/46/ 92/426/532, 24/46/92/426/549, 24/46/95/99/426/532, 24/46/ 99/426/549/600, 24/46/404/426/485/532, 24/96/404/426, 24/99, 24/99/404/485/532/600, 24/296, 24/296/324/480, 24/404/426/532, 24/404/480/485, 24/404/480/532/549/560, 36, 36/92/95/99/404/426/560, 36/92/95/428/596, 36/92/96/ 408/428/540/596, 36/92/485, 36/258/296, 36/258/296/324/ 433/626, 36/404, 36/404/426/549/600, 36/408/537/596, 36/408/596, 36/426/485/600, 46, 46/92/560, 92, 92/95/485/ 532/549/560, 92/99/218/560, 95, 95/120/296/626, 95/404/ 426/532, 96, 96/99, 96/258/560/626, 99, 99/404/426/560, 99/426/480/485, 120, 120/324/480/560, 218, 218/408, 296/ 324, 296/324/560, 324/560, 404, 404/485/600, 408, 480, 485, 532, 537, 537/640, 549, 549/560, 560, 596, and 600, wherein the amino acid positions of the polypeptide sequence are numbered with reference to SEQ ID NO: 2424. In some embodiments, the engineered galactose oxidase comprises at least one substitution or substitution set selected from 14A/24V/36P/96G, 14A/24V/36P/296R/ 424W/560M, 14A/24V/78I/120L/258V, 14A/24V/96G/ 258V/626G, 14A/24V/258V/560M, 14A/78I/120L/258V/ 488T/560M/626G, 14A/95R/120L/296R/480R/560M, 14A/ 120L/480R/626G, 14A/258V, 14A/258V/296R/560M, 14L, 14L/92V/96S/99L, 14L/92V/96S/99L/120S/537C, 14L/ 92V/96S/120S/376M, 14R, 14R/24P/92C/96S/99L/408R, 14R/92V/99L/120S/537C, 14R/376M/560I, 14R/408Q, 23A/36L/92C/95F/96G, 23A/36L/92C/95F/99F/408L/ 596V, 23A/36L/408L/428H, 23A/36L/537W/596Q, 23A/ 218G/537W, 23A/408L/596V, 24P, 24P/36L/46E/99V/ 426W/532G/549L, 24P/36L/95S/99V/404A/426W/485C, 24P/36L/96M/99V/532G/549L, 24P/36L/99V/404A/426W/ 532G/549L/600N, 24P/36L/404A/426W/532G, 24P/36L/ 404A/480L/485C/532G/560E/600N, 24P/46E/92G/404A/ 426W/532G, 24P/46E/92G/426W/532G, 24P/46E/92G/ 426W/549L, 24P/46E/95S/99V/426W/532G, 24P/46E/99V/ 426W/549L/600N, 24P/46E/404A/426W/485C/532G, 24P/ 96M/404A/426W, 24P/99V, 24P/99V/404A/485C/532G/ 600N, 24P/404A/426W/532G, 24P/404A/480L/485C, 24P/ 404A/480L/532G/549L/560E, 24V/36P/95R/96G, 24V/ 36P/120L/296R/480R/560M, 24V/296R, 24V/296R/324F/ 480R, 36L, 36L/92C/95F/428H/596Q, 36L/92C/96G/408L/ 428H/540R/596V, 36L/92G/95S/99V/404A/426W/560E, 36L/92G/485C, 36L/404A, 36L/404A/426W/549L/600N, 36L/408L/537W/596Q, 36L/408L/596Q, 36L/426W/485C/ 600N, 36P/258V/296R, 36P/258V/296R/324F/433G/626G, 46P, 46P/92V/560I, 92C, 92G, 92G/95S/485C/532G/549L/ 560E, 92V, 92V/99L/218M/560I, 95A, 95F, 95R/120L/ 296R/626G, 95S/404A/426W/532G, 96G, 96L/258V/ 560M/626G, 96M, 96S, 96S/99L, 99L, 99V, 99V/404A/ 426W/560E, 99V/426W/480L/485C, 120L/324F/480R/ 560M, 120S, 218G/408L, 218M, 296R/324F, 296R/324F/ 560M, 324F/560M, 404A, 404A/485C/600N, 408L, 408Q, 480L, 480R, 485C, 532G, 537C, 537W/640R, 549L, 549L/ 560E, 560I, 596V, and 600N, wherein the amino acid positions of the polypeptide sequence are numbered with reference to SEQ ID NO: 2424. In some embodiments, the engineered galactose oxidase comprises at least one substitution or substitution set selected from N14A/S24V/K36P/ N96G, N14A/S24V/K36P/V296R/G424W/W560M, N14A/ S24V/N78I/R120L/S258V, N14A/S24V/N96G/S258V/ S626G, N14A/S24V/S258V/W560M, N14A/N78I/R120L/ S258V/N488T/W560M/S626G, N14A/V95R/R120L/ V296R/E480R/W560M, N14A/R120L/E480R/S626G, N14A/S258V, N14A/S258V/V296R/W560M, N14L, N14L/ S92V/N96S/S99L, N14L/S92V/N96S/S99L/R120S/S537C, N14L/S92V/N96S/R120S/R376M, N14R, N14R/S24P/ S92C/N96S/S99L/D408R, N14R/S92V/S99L/R120S/

5537C, N14R/R376M/W560I, N14R/D408Q, Q23A/K36L/ S92C/V95F/N96G, Q23A/K36L/S92C/V95F/S99F/D408L/ T596V, Q23A/K36L/D408L/N428H, Q23A/K36L/S537W/ T596Q, Q23A/R218G/S537W, Q23A/D408L/T596V, S24P, S24P/K36L/V46E/S99V/S426W/N532G/R549L, S24P/ K36L/V95S/S99V/P404A/S426W/Y485C, S24P/K36L/ N96M/S99V/N532G/R549L, S24P/K36L/S99V/P404A/ S426W/N532G/R549L/G600N, S24P/K36L/P404A/ S426W/N532G, S24P/K36L/P404A/E480L/Y485C/ N532G/W560E/G600N, S24P/V46E/S92G/P404A/S426W/ N532G, S24P/V46E/S92G/S426W/N532G, S24P/V46E/ S92G/S426W/R549L, S24P/V46E/V95S/S99V/S426W/ N532G, S24P/V46E/S99V/S426W/R549L/G600N, S24P/ V46E/P404A/S426W/Y485C/N532G, S24P/N96M/P404A/ S426W, S24P/S99V, S24P/S99V/P404A/Y485C/N532G/ G600N, S24P/P404A/S426W/N532G, S24P/P404A/E480L/ Y485C, S24P/P404A/E480L/N532G/R549L/W560E, S24V/K36P/V95R/N96G, S24V/K36P/R120L/V296R/ E480R/W560M, S24V/V296R, S24V/V296R/A324F/ E480R, K36L, K36L/S92C/V95F/N428H/T596Q, K36L/ S92C/N96G/D408L/N428H/N540R/T596V, K36L/S92G/ V95S/S99V/P404A/S426W/W560E, K36L/S92G/Y485C, K36L/P404A, K36L/P404A/S426W/R549L/G600N, K36L/ D408L/S537W/T596Q, K36L/D408L/T596Q, K36L/ S426W/Y485C/G600N, K36P/S258V/V296R, K36P/ S258V/V296R/A324F/S433G/S626G, V46P, V46P/S92V/ W560I, S92C, S92G, S92G/V95S/Y485C/N532G/R549L/ W560E, S92V, S92V/S99L/R218M/W560I, V95A, V95F, V95R/R120L/V296R/S626G, V95S/P404A/S426W/ N532G, N96G, N96L/S258V/W560M/S626G, N96M, N96S, N96S/S99L, S99L, S99V, S99V/P404A/S426W/ W560E, S99V/S426W/E480L/Y485C, R120L/A324F/ E480R/W560M, R120S, R218G/D408L, R218M, V296R/ A324F, V296R/A324F/W560M, A324F/W560M, P404A, P404A/Y485C/G600N, D408L, D408Q, E480L, E480R, Y485C, N532G, S537C, S537W/Q640R, R549L, R549L/ W560E, W560I, T596V, and G600N, wherein the amino acid positions of the polypeptide sequence are numbered with reference to SEQ ID NO: 2424.

In some embodiments, the engineered galactose oxidase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 2424, and wherein the engineered galactose oxidase comprises at least one substitution or substitution set at one or more positions in the polypeptide sequence selected from 14, 14/24/36/96, 14/24/36/296/424/560, 14/24/78/120/258, 14/24/99/218/408/537/560, 14/24/258/560, 14/46/47/376, 14/46/96/99/560, 14/92/96/99/376/560, 14/92/96/120/376, 14/92/96/376, 14/92/99/120/218/408, 14/92/99/120/537, 14/92/99/218/408, 14/92/218/408, 14/95/120/296/480/560, 14/376, 14/376/537, 14/376/560, 14/408, 14/537, 23/36, 23/36/92/95/96, 23/36/92/95/99/408/596, 23/36/96/408/ 596/640, 23/36/408/428, 23/36/537/540/640, 23/36/537/ 596, 23/218/596/640, 24, 24/36/46/99/426/532/549, 24/36/ 95/96, 24/36/95/99/404/426/485, 24/36/96/99/532/549, 24/36/120/296/480/560, 24/36/404/426/532, 24/36/404/ 480/485/532/560/600, 24/46/92/404/426/532, 24/46/92/ 426/532, 24/46/92/426/549, 24/46/95/99/426/532, 24/46/99/ 426/549/600, 24/46/404/426/485/532, 24/96/404/426, 24/96/404/426/560, 24/99, 24/296, 24/404/426/532, 24/404/ 480/485, 24/532, 36, 36/92/95/428/596, 36/95/96, 36/99/ 426/485/600, 36/258/296, 36/258/296/324/433/626, 36/404, 36/404/426/549/600, 36/408, 36/408/537/596, 36/426/485/ 600, 46/92/560, 78, 92, 92/95/485/532/549/560, 92/96, 92/99/120, 92/99/218/560, 92/218, 92/404, 95, 96, 96/99, 99, 99/426/480/485, 99/640, 120, 120/324/480/560, 120/ 376, 218/537/596, 218/596, 258, 296, 296/324, 296/324/ 560, 296/480/560, 324, 361, 404, 404/426/485, 408/596, 424, 426/485, 426/532/549, 480, 532, 537/640, 549, 549/ 560, 560, 600, 626, and 640, wherein the amino acid positions of the polypeptide sequence are numbered with reference to SEQ ID NO: 2424. In some embodiments, the engineered galactose oxidase comprises at least one substitution or substitution set selected from 14A/24V/36P/96G, 14A/24V/36P/296R/424W/560M, 14A/24V/78I/120L/ 258V, 14A/24V/258V/560M, 14A/95R/120L/296R/480R/ 560M, 14L/92C/218M/408Q, 14L/92V/96S/120S/376M, 14L/92V/99L/120S/218M/408R, 14L/376M, 14L/376M/ 537C, 14L/376M/560I, 14R, 14R/24P/99L/218M/408Q/ 537C/560I, 14R/46P/47P/376M, 14R/46P/96S/99L/560I, 14R/92C/96S/376M, 14R/92V/96S/99L/376M/560I, 14R/ 92V/99L/120S/537C, 14R/92V/99L/218M/408Q, 14R/ 408Q, 14R/537C, 23A/36L, 23A/36L/92C/95F/96G, 23A/ 36L/92C/95F/99F/408L/596V, 23A/36L/96G/408L/596V/ 640R, 23A/36L/408L/428H, 23A/36L/537W/540R/640R, 23A/36L/537W/596Q, 23A/218G/596Q/640R, 24P, 24P/ 36L/46E/99V/426W/532G/549L, 24P/36L/95S/99V/404A/ 426W/485C, 24P/36L/96M/99V/532G/549L, 24P/36L/ 404A/426W/532G, 24P/36L/404A/480L/485C/532G/560E/ 600N, 24P/46E/92G/404A/426W/532G, 24P/46E/92G/ 426W/532G, 24P/46E/92G/426W/549L, 24P/46E/95S/99V/ 426W/532G, 24P/46E/99V/426W/549L/600N, 24P/46E/ 404A/426W/485C/532G, 24P/96M/404A/426W, 24P/96M/ 404A/426W/560E, 24P/99V, 24P/404A/426W/532G, 24P/ 404A/480L/485, 24P/532G, 24V, 24V/36P/95R/96G, 24V/36P/120L/296R/480R/560M, 24V/296R, 36L, 36L/ 92C/95F/428H/596Q, 36L/95F/96G, 36L/99V/426W/485C/ 600N, 36L/404A, 36L/404A/426W/549L/600N, 36L/408L, 36L/408L/537W/596Q, 36L/426W/485C/600N, 36P/258V/ 296R, 36P/258V/296R/324F/433G/626G, 46P/92V/560I, 78I, 92G, 92G/95S/485C/532G/549L/560E, 92G/404A, 92V/96S, 92V/99L/120S, 92V/99L/218M/560I, 92V/218M, 95A, 95F, 96G, 96M, 96S/99L, 99L/640R, 99V, 99V/426W/ 480L/485C, 120L, 120L/324F/480R/560M, 120S/376M, 218G/537W/596V, 218G/596Q, 258V, 296R, 296R/324F, 296R/324F/560M, 296R/480R/560M, 324F, 361P, 404A, 404A/426W/485C, 408L/596Q, 424W, 426W/485C, 426W/ 532G/549L, 480L, 480R, 532G, 537W/640R, 549L, 549L/ 560E, 560M, 600N, 626G, and 640R, wherein the amino acid positions of the polypeptide sequence are numbered with reference to SEQ ID NO: 2424. In some embodiments, the engineered galactose oxidase comprises at least one substitution or substitution set selected from N14A/S24V/ K36P/N96G, N14A/S24V/K36P/V296R/G424W/W560M, N14A/S24V/N78I/R120L/S258V, N14A/S24V/S258V/ W560M, N14A/V95R/R120L/V296R/E480R/W560M, N14L/S92C/R218M/D408Q, N14L/S92V/N96S/R120S/ R376M, N14L/S92V/S99L/R120S/R218M/D408R, N14L/ R376M, N14L/R376M/S537C, N14L/R376M/W560I, N14R, N14R/S24P/S99L/R218M/D408Q/S537C/W560I, N14R/V46P/N47P/R376M, N14R/V46P/N96S/S99L/ W560I, N14R/S92C/N96S/R376M, N14R/S92V/N96S/ S99L/R376M/W560I, N14R/S92V/S99L/R120S/S537C, N14R/S92V/S99L/R218M/D408Q, N14R/D408Q, N14R/ S537C, Q23A/K36L, Q23A/K36L/S92C/V95F/N96G, Q23A/K36L/S92C/V95F/S99F/D408L/T596V, Q23A/ K36L/N96G/D408L/T596V/Q640R, Q23A/K36L/D408L/ N428H, Q23A/K36L/S537W/N540R/Q640R, Q23A/K36L/ S537W/T596Q, Q23A/R218G/T596Q/Q640R, S24P, S24P/ K36L/V46E/S99V/S426W/N532G/R549L, S24P/K36L/ V95S/S99V/P404A/S426W/Y485C, S24P/K36L/N96M/ S99V/N532G/R549L, S24P/K36L/P404A/S426W/N532G, S24P/K36L/P404A/E480L/Y485C/N532G/W560E/G600N, S24P/V46E/S92G/P404A/S426W/N532G, S24P/V46E/ S92G/S426W/N532G, S24P/V46E/S92G/S426W/R549L, S24P/V46E/V95S/S99V/S426W/N532G, S24P/V46E/ S99V/S426W/R549L/G600N, S24P/V46E/P404A/S426W/ Y485C/N532G, S24P/N96M/P404A/S426W, S24P/N96M/ P404A/S426W/W560E, S24P/S99V, S24P/P404A/S426W/ N532G, S24P/P404A/E480L/Y485C, S24P/N532G, S24V, S24V/K36P/V95R/N96G, S24V/K36P/R120L/V296R/ E480R/W560M, S24V/V296R, K36L, K36L/S92C/V95F/ N428H/T596Q, K36L/V95F/N96G, K36L/S99V/S426W/ Y485C/G600N, K36L/P404A, K36L/P404A/S426W/ R549L/G600N, K36L/D408L, K36L/D408L/S537W/ T596Q, K36L/S426W/Y485C/G600N, K36P/S258V/ V296R, K36P/S258V/V296R/A324F/S433G/S626G, V46P/ S92V/W560I, N78I, S92G, S92G/V95S/Y485C/N532G/ R549L/W560E, S92G/P404A, S92V/N96S, S92V/S99L/ R120S, S92V/S99L/R218M/W560I, S92V/R218M, V95A, V95F, N96G, N96M, N96S/S99L, S99L/Q640R, S99V, S99V/S426W/E480L/Y485C, R120L, R120L/A324F/ E480R/W560M, R120S/R376M, R218G/S537W/T596V, R218G/T596Q, S258V, V296R, V296R/A324F, V296R/ A324F/W560M, V296R/E480R/W560M, A324F, S361P, P404A, P404A/S426W/Y485C, D408L/T596Q, G424W, S426W/Y485C, S426W/N532G/R549L, E480L, E480R, N532G, S537W/Q640R, R549L, R549L/W560E, W560M, G600N, S626G, and Q640R, wherein the amino acid positions of the polypeptide sequence are numbered with reference to SEQ ID NO: 2424.

In yet some additional embodiments, the engineered galactose oxidase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered galactose oxidase variant set forth in Table 4.1, 5.1, 6.1, 7.1, 11.1, 12.1, 13.1, 14.1, 14.2, 15.1, 16.1, 17.1, 18.1, 19.1, 22.1, 23.1, 25.1, 26.1, 27.1, 28.1, 29.2, 30.1, and/or 31.1. In still some further embodiments, the engineered galactose oxidase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered galactose oxidase variant set forth in SEQ ID NO: 2, 4, 166, 272, 928, 932, 1264, 1416, 1598, 1866, 1912, 2080, 2300, and/or 2424. In some embodiments, the engineered galactose oxidase is a variant engineered polypeptide set forth in SEQ ID NO: 2, 4, 166, 272, 928, 932, 1264, 1416, 1598, 1866, 1912, 2080, 2300, and/or 2424. In some further embodiments, the engineered galactose oxidase comprises a polypeptide sequence that is at least 85%, 86%, 87%, 88%, 89%, 90%, 91%, 92%, 93%, 94%, 95%, 96%, 97%, 98%, 99% or more identical to the sequence of at least one engineered galactose oxidase variant set forth in the even numbered sequences of SEQ ID NOS: 2-2860. In still some additional embodiments, the engineered galactose oxidase comprises a polypeptide sequence set forth in the even numbered sequences of SEQ ID NOS: 2-2860. In some further embodiments, the engineered galactose oxidase comprises at least one improved property compared to wild-type *F. graminearium* galactose oxidase. In some embodiments, the improved property comprises improved activity on a substrate. In some additional embodiments, the substrate comprises a primary alcohol. In some further embodiments, the improved property comprises improved stereoselectivity. In yet some additional embodiments, the engineered galactose oxidase is purified.

The present invention also provides compositions comprising at least one engineered galactose oxidase provided herein. In some embodiments, the composition comprises one engineered galactose oxidase provided herein.

The present invention also provides polynucleotide sequences encoding the engineered galactose oxidases provided herein. In some embodiments, the polynucleotide sequences encode more than one of the engineered galactose oxidases provided herein. The present invention also provides polynucleotide sequences encoding at least one engineered galactose oxidase, wherein the polynucleotide sequence comprises at least 85%, 86%, 87%, 88%, 89%, 90%, 91%, 92%, 93%, 94%, 95%, 96%, 97%, 98%, 99%, or more sequence identity to SEQ ID NOS: 1, 3, 165, 271, 927, 931, 1263, 1415, 1597, 1865, 1911, 2079, 2299, and/or 2423, wherein the polynucleotide sequence of the engineered galactose oxidase comprises at least one substitution at one or more positions. In some additional embodiments, the polynucleotide sequence encoding at least one engineered galactose oxidase comprises at least 85%, 86%, 87%, 88%, 89%, 90%, 91%, 92%, 93%, 94%, 95%, 96%, 97%, 98%, 99%, or more sequence identity to SEQ ID NOS: 1, 3, 165, 271, 927, 931, 1263, 1415, 1597, 1865, 1911, 2079, 2299, and/or 2423, or a functional fragment thereof. In some further embodiments, the polynucleotide sequence is operably linked to a control sequence. In some additional embodiments, the polynucleotide sequence is codon optimized. In yet some further embodiments, the polynucleotide comprises an odd-numbered sequence of SEQ ID NOS: 1-2859. The present invention also provides expression vectors comprising at least one polynucleotide sequence encoding at least one galactose oxidase provided herein. The present invention also provides host cells comprising at least one expression vector provided herein. The present invention also provides host cells comprising at least one polynucleotide sequence encoding at least one galactose oxidase provided herein.

The present invention also provides methods of producing an engineered galactose oxidase in a host cell, comprising culturing a host cell under suitable conditions, such that at least one engineered galactose oxidase provided herein is produced. In some embodiments, the methods further comprise recovering at least one engineered galactose oxidase from the culture and/or host cell. In some additional embodiments, the methods further comprise the step of purifying the at least one engineered galactose oxidase provided herein.

DESCRIPTION OF THE INVENTION

The present invention provides engineered galactose oxidase (GOase) enzymes, polypeptides having selective oxidative activity on primary alcohols (e.g. 2-ethynylglycerol), and polynucleotides encoding these enzymes, as well as vectors and host cells comprising these polynucleotides and polypeptides. These GOase variants act in a selective manner, minimizing the need for functional group protection operations for untargeted alcohols, as well as providing the desired aldehyde stereoisomer (e.g., R-enantiomer). Methods for producing GOase enzymes are also provided. The present invention further provides compositions comprising the GOase enzymes and methods of using the engineered GOase enzymes. The present invention finds particular use in the production of pharmaceutical and other compounds.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations

The abbreviations used for the genetically encoded amino acids are conventional and are as follows: alanine (Ala or A), arginine (Are or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

When the three-letter abbreviations are used, unless specifically preceded by an "L" or a "D" or clear from the context in which the abbreviation is used, the amino acid may be in either the L- or D-configuration about α-carbon (Cα). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

Definitions

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

As used herein, the term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, "galactose oxidase" ("GOase"; EC 1.1.3.9) enzymes are copper-dependent enzymes, that, in the presence of bimolecular oxygen, catalyze the oxidation of primary alcohols to the corresponding aldehyde. They selectively act in both regio- and enantiospecific manners, resulting in synthetic approaches that require little or no functional group protection and yield the desired stereoisomer. The manner of oxidation is mild and controlled, such that activity does not lead to over-oxidation of the alcohol to its corresponding carboxylic acid.

As used herein, "horseradish peroxidase" (HRP, EC 1.11.1.7) enzyme is an iron-dependent enzyme that activates and maintains GOase catalytic activity by oxidizing an inactive redox state of the active site that occurs during normal GOase catalytic cycling. Type I HRP is specifically employed in a catalytic manner in the examples included herein, however it is not meant to be exclusive in this role, as there are other isoforms of this enzyme class and chemical reagents that can fulfill this role.

As used herein, "catalase" refers to an iron-dependent enzyme (EC 1.11.1.6) which acts on hydrogen peroxide, a byproduct of GOase oxidation, which can render GOase inactive above certain levels of hydrogen peroxide. Catalase is employed as a catalytic maintenance enzyme specifically in the examples herein, while in some embodiments it could be replaced by other methods, such as electrochemical decomposition of hydrogen peroxide.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pKa value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pKa value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "polynucleotide" and "nucleic acid" refer to two or more nucleotides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

As used herein, "recombinant," "engineered," "variant," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

As used herein, "reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences.

The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered galactose oxidase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. In some cases, the reference sequence has a histidine tag, but the numbering is maintained relative to the equivalent reference sequence without the histidine tag. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acid having an aromatic side chain is substituted with another amino acid having an aromatic side chain (e.g., phenylalanine, tyrosine, tryptophan, and histidine); an amino acid with a basic side chain is substituted with another amino acid with a basic side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered galactose oxidase enzyme. Deletions can be directed to the internal portions and/or terminal portions of the polypeptide. In various embodiments, the deletion can comprise a continuous segment or can be discontinuous. Deletions are typically indicated by "-" in amino acid sequences.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant galactose oxidases listed in the Tables provided in the Examples A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered galactose oxidase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant galactose oxidase polypeptides may be present within a cell, present in the cellular medium, or prepared in various forms, such as lysates or isolated preparations. As such, in some embodiments, the recombinant galactose oxidase polypeptides can be an isolated polypeptide.

As used herein, "substantially pure polypeptide" or "purified protein" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising galactose oxidase comprises galactose oxidase that is less than 50% pure (e.g., about 10%, about 20%, about 30%, about 40%, or about 50%). Generally, a substantially pure galactose oxidase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant galactose oxidase polypeptides are substantially pure polypeptide compositions.

As used herein, "improved enzyme property" refers to at least one improved property of an enzyme. In some embodiments, the present invention provides engineered galactose oxidase polypeptides that exhibit an improvement in any enzyme property as compared to a reference galactose oxidase polypeptide and/or a wild-type galactose oxidase polypeptide, and/or another engineered galactose oxidase polypeptide. Thus, the level of "improvement" can be determined and compared between various galactose oxidase polypeptides, including wild-type, as well as engineered galactose oxidases. Improved properties include, but are not limited to, such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of galactose oxidase enzymes. In some embodiments, the present invention provides engineered galactose oxidase polypeptides that exhibit an improvement in any enzyme property as compared to a reference galactose oxidase polypeptide and/ or a wild-type galactose oxidase polypeptide, and/or another engineered galactose oxidase polypeptide. Thus, the level of "improvement" can be determined and compared between various galactose oxidase polypeptides, including wild-type, as well as engineered galactose oxidases.

As used herein, "increased enzymatic activity" and "enhanced catalytic activity" refer to an improved property of the engineered polypeptides, which can be represented by an increase in specific activity (e.g., product produced/time/ weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered galactose oxidase polypeptides provided herein, which can be represented by an increase in specific activity (e.g., product produced/time/ weight protein) or an increase in percent conversion of the substrate to the product (e.g., percent conversion of starting amount of substrate to product in a specified time period using a specified amount of galactose oxidase) as compared to the reference galactose oxidase enzyme. In some embodiments, the terms are used in reference to improved galactose oxidase enzymes provided herein. Exemplary methods to determine enzyme activity of the engineered galactose oxidases of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1-fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring galactose oxidase or another engineered galactose oxidase from which the galactose oxidase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a galactose oxidase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides galactose oxidase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1962]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, Mass. [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered galactose oxidase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the galactose oxidase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which a galactose oxidase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the engineered enzymes provided herein (e.g., engineered galactose oxidase polypeptides).

As used herein, "increasing" yield of a product (e.g., the R-enantiomer of 3-ethynylglyceraldehyde [EGA]) from a reaction occurs when a particular component present during the reaction (e.g., a galactose oxidase enzyme) causes more product to be produced, compared with a reaction conducted under the same conditions with the same substrate and other substituents, but in the absence of the component of interest.

A reaction is said to be "substantially free" of a particular enzyme if the amount of that enzyme compared with other enzymes that participate in catalyzing the reaction is less than about 2%, about 1%, or about 0.1% (wt/wt).

As used herein, "fractionating" a liquid (e.g., a culture broth) means applying a separation process (e.g., salt precipitation, column chromatography, size exclusion, and filtration) or a combination of such processes to provide a solution in which a desired protein comprises a greater percentage of total protein in the solution than in the initial liquid product.

As used herein, "starting composition" refers to any composition that comprises at least one substrate. In some embodiments, the starting composition comprises any suitable substrate.

As used herein, "product" in the context of an enzymatic conversion process refers to the compound or molecule resulting from the action of an enzymatic polypeptide on a substrate.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

"Cofactor," as used herein, refers to a non-protein compound that operates in combination with an enzyme in catalyzing a reaction.

As used herein, "alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., $(C_1-C_4)$alkyl refers to an alkyl of 1 to 4 carbon atoms).

As used herein, "alkenyl" refers to groups of from 2 to 12 carbon atoms inclusively, either straight or branched containing at least one double bond but optionally containing more than one double bond.

As used herein, "alkynyl" refers to groups of from 2 to 12 carbon atoms inclusively, either straight or branched containing at least one triple bond but optionally containing more than one triple bond, and additionally optionally containing one or more double bonded moieties.

As used herein, "heteroalkyl, "heteroalkenyl," and heteroalkynyl," refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NR$^\alpha$—, —PH—, —S(O)—, —S(P)2-, —S(O) NR$^\alpha$—, —S(O)$_2$NR$^\alpha$—, and the like, including combinations thereof, where each R$^\alpha$ is independently selected from hydrogen, alkyl, heteroalkyl, cycloalkyl, heterocycloalkyl, aryl, and heteroaryl.

As used herein, "alkoxy" refers to the group —OR$^\beta$ wherein R$^\beta$ is an alkyl group is as defined above including optionally substituted alkyl groups as also defined herein.

As used herein, "aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

As used herein, "amino" refers to the group —NH$_2$. Substituted amino refers to the group —NHR$^\delta$, NR$^\delta$R$^\delta$, and NR$^\delta$R$^\delta$R$^\delta$, where each R$^\delta$ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylysulfonylamino, furanyl-oxy-sulfamino, and the like.

As used herein, "oxo" refers to =O.

As used herein, "oxy" refers to a divalent group —O—, which may have various substituents to form different oxy groups, including ethers and esters.

As used herein, "carboxy" refers to —COOH.

As used herein, "carbonyl" refers to —C(O)—, which may have a variety of substituents to form different carbonyl groups including acids, acid halides, aldehydes, amides, esters, and ketones.

As used herein, "alkyloxycarbonyl" refers to —C(O)OR$^\varepsilon$, where R$^\varepsilon$ is an alkyl group as defined herein, which can be optionally substituted.

As used herein, "aminocarbonyl" refers to —C(O)NH$_2$. Substituted aminocarbonyl refers to —C(O)NR$^\delta$R$^\delta$, where the amino group NR$^\delta$R$^\delta$ is as defined herein.

As used herein, "halogen" and "halo" refer to fluoro, chloro, bromo and iodo.

As used herein, "hydroxy" refers to —OH.

As used herein, "cyano" refers to —CN.

As used herein, "heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

As used herein, "heteroarylalkyl" refers to an alkyl substituted with a heteroaryl (i.e., heteroaryl-alkyl- groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

As used herein, "heteroarylalkenyl" refers to an alkenyl substituted with a heteroaryl (i.e., heteroaryl-alkenyl- groups), preferably having from 2 to 6 carbon atoms inclusively in the alkenyl moiety and from 5 to 12 ring atoms inclusively in the heteroaryl moiety.

As used herein, "heteroarylalkynyl" refers to an alkynyl substituted with a heteroaryl (i.e., heteroaryl-alkynyl- groups), preferably having from 2 to 6 carbon atoms inclusively in the alkynyl moiety and from 5 to 12 ring atoms inclusively in the heteroaryl moiety.

As used herein, "heterocycle," "heterocyclic," and interchangeably "heterocycloalkyl," refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

As used herein, "membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as E. coli, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837, 458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

After the variants are produced, they can be screened for any desired property (e.g., high or increased activity, or low or reduced activity, increased thermal activity, increased thermal stability, and/or acidic pH stability, etc.). In some embodiments, "recombinant galactose oxidase polypeptides" (also referred to herein as "engineered galactose oxidase polypeptides," "variant galactose oxidase enzymes," "galactose oxidase variants," and "galactose oxidase combinatorial variants") find use. In some embodiments, "recombinant galactose oxidase polypeptides" (also referred to as "engineered galactose oxidase polypeptides," "variant galactose oxidase enzymes," "galactose oxidase variants," and "galactose oxidase combinatorial variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the galactose oxidase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess ("e.e.") calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess ("d.e."). Enantiomeric excess and diastereomeric excess are types of stereomeric excess.

As used herein, "regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "chemoselectivity" refers to the preferential formation in a chemical or enzymatic reaction of one product over another.

As used herein, "pH stable" refers to a galactose oxidase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermostable" refers to a galactose oxidase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a galactose oxidase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a galactose oxidase polypeptide that is both thermostable and solvent stable.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included.

As used herein, "optionally substituted" refers to all subsequent modifiers in a term or series of chemical groups. For example, in the term "optionally substituted arylalkyl," the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

As used herein, "protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups are well-known in the art. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

DETAILED DESCRIPTION OF THE INVENTION

The present invention provides engineered galactose oxidase (GOase) enzymes, polypeptides having GOase activity, and polynucleotides encoding these enzymes, as well as vectors and host cells comprising these polynucleotides and polypeptides. Methods for producing GOase enzymes are also provided. The present invention further provides compositions comprising the GOase enzymes and methods of using the engineered GOase enzymes. The present invention finds particular use in the production of pharmaceutical and other compounds.

Galactose oxidase (GOase) from *F. graminearium* is a naturally-occurring copper-dependent enzyme capable of performing oxidations on primary alcohol-containing substrates under mild reaction conditions. In addition to copper, the enzyme relies on a post-translationally formed cofactor, which is the result of the bound copper and molecular oxygen-mediated cross-linking of the active site residues tyrosine and cysteine. The enzyme is then active and capable of catalyzing the oxidation of primary alcohols by reducing oxygen and producing an aldehyde and hydrogen peroxide via a radical mechanism.

Scheme 1: Oxidation of Primary Alcohols by Galactose Oxidase

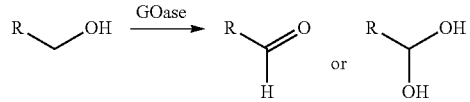

Early directed evolution efforts were performed which focused on evolving a GOase variant with improved selectivity and activity on 3-ethynylglycerol (EGO) for generating the corresponding aldehyde. An initial evolved variant demonstrated only slight enrichment for the S-enantiomer of 3-ethynylglyceraldehyde (EGA). This enzyme was further evolved to a variant that possessed enantioselectivity which favored formation of the R-enantiomer (See, Scheme 2). Additional directed evolution was needed in order to further enhance the R-enantioselectivity and improve oxidation activity at process conditions.

Scheme 2: Oxidation of 3-Ethynylglycerol via Galactose Oxidase.

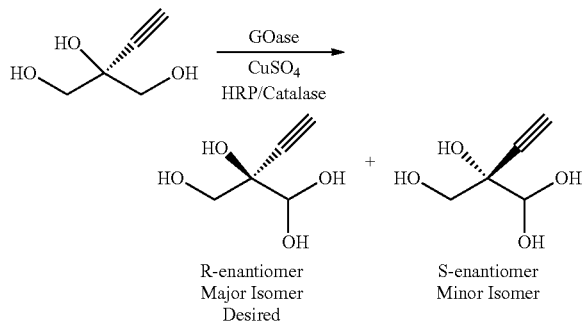

R-enantiomer
Major Isomer
Desired

S-enantiomer
Minor Isomer

Further directed evolution efforts were performed which focused on evolving a GOase variant with improved activity on the ethynyl glycerol phosphate (EGP) for generating the corresponding phosphorylated aldehyde (Compound P) (See, Scheme 3).

Scheme 3: Oxidation of Ethynyl glycerol phosphate via Galactose Oxidase

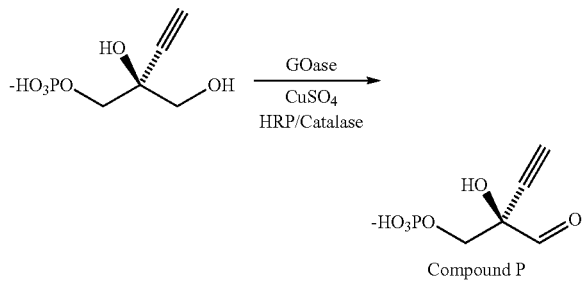

Compound P

Engineered GOase Polypeptides

The present invention provides engineered GOase polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring GOase enzymes with improved properties as compared to wild-type GOase enzymes. Any suitable reaction conditions find use in the present invention. In some embodiments, methods are used to analyze the improved properties of the engineered polypeptides to carry out the oxidation reaction. In some embodiments, the reaction conditions are modified with regard to concentrations or amounts of engineered GOase, substrate(s), buffer(s), solvent(s), co-factors, pH, conditions including temperature and reaction time, and/or conditions with the engineered GOase polypeptide immobilized on a solid support, as further described below and in the Examples.

In some embodiments, additional reaction components or additional techniques are utilized to supplement the reaction conditions. In some embodiments, these include taking measures to stabilize or prevent inactivation of the enzyme, reduce product inhibition, shift reaction equilibrium to desired product formation.

In some further embodiments, any of the above described processes for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) from biocatalytic reaction mixtures produced by the processes provided herein are known to the ordinary artisan and/or accessed through routine experimentation. Additionally, illustrative methods are provided in the Examples below.

Engineered GOase Polynucleotides Encoding Engineered Polypeptides,
Expression Vectors and Host Cells The present invention provides polynucleotides encoding the engineered enzyme polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered enzyme polypeptide(s) is introduced into appropriate host cells to express the corresponding enzyme polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered enzyme (e.g., GOase) polypeptide. Thus, the present invention provides methods and compositions for the production of each and every possible variation of enzyme polynucleotides that could be made that encode the enzyme polypeptides described herein by selecting combinations based on the possible codon choices, and all such variations are to be considered specifically disclosed for any polypeptide described herein, including the amino acid sequences presented in the Examples (e.g., in the various Tables).

In some embodiments, the codons are preferably optimized for utilization by the chosen host cell for protein production. For example, preferred codons used in bacteria are typically used for expression in bacteria. Consequently, codon optimized polynucleotides encoding the engineered enzyme polypeptides contain preferred codons at about 40%, 50%, 60%, 70%, 80%, 90%, or greater than 90% of the codon positions in the full length coding region.

In some embodiments, the enzyme polynucleotide encodes an engineered polypeptide having enzyme activity with the properties disclosed herein, wherein the polypeptide comprises an amino acid sequence having at least 60%, 65%, 70%, 75%, 80%, 85%, 86%, 87%, 88%, 89%, 90%, 91%, 92%, 93%, 94%, 95%, 96%, 97%, 98%, 99% or more identity to a reference sequence selected from the SEQ ID NOS provided herein, or the amino acid sequence of any variant (e.g., those provided in the Examples), and one or more residue differences as compared to the reference polynucleotide(s), or the amino acid sequence of any variant as disclosed in the Examples (for example 1, 2, 3, 4, 5, 6, 7, 8, 9, 10 or more amino acid residue positions). In some embodiments, the reference polypeptide sequence is selected from SEQ ID NO: 2, 4, 166, 272, 928, 932, 1264, 1416, 1598, 1866, 1912, 2080, 2300, and/or 2424.

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes an enzyme polypeptide comprising an amino acid sequence that has one or more residue differences as compared to a reference sequence.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides. Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the E. coli lac operon, Streptomyces coelicolor agarase gene (dagA), Bacillus subtilis levansucrase gene (sacB), Bacillus licheniformis alpha-amylase gene (amyL), Bacillus stearothermophilus maltogenic amylase gene (amyM), Bacillus amyloliquefaciens alpha-amylase gene (amyQ), Bacillus licheniformis penicillinase gene (penP), Bacillus subtilis xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for Aspergillus oryzae TAKA amylase, Rhizomucor miehei aspartic proteinase, Aspergillus niger neutral alpha-amylase, Aspergillus niger acid stable alpha-amylase, Aspergillus niger or Aspergillus awamori glucoamylase (glaA), Rhizomucor miehei lipase, Aspergillus oryzae alkaline protease, Aspergillus oryzae triose phosphate isomerase, Aspergillus nidulans acetamidase, and Fusarium oxysporum trypsin-like protease (See e.g., WO 96/00787), as well as the NA2-tpi promoter (a hybrid of the promoters from the genes for Aspergillus niger neutral alpha-amylase and Aspergillus oryzae triose phosphate isomerase), and mutant, truncated, and hybrid promoters thereof. Exemplary yeast cell promoters can be from the genes can be from the genes for Saccharomyces cerevisiae enolase (ENO-1), Saccharomyces cerevisiae galactokinase (GAL1), Saccharomyces cerevisiae alcohol dehydrogenase/glyceraldehyde-3-phosphate dehydrogenase (ADH2/GAP), and Saccharomyces cerevisiae 3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for Aspergillus oryzae TAKA amylase, Aspergillus niger glucoamylase, Aspergillus nidulans anthranilate synthase, Aspergillus niger alpha-glucosidase, and Fusarium oxysporum trypsin-like protease. Exemplary terminators for yeast host cells can be obtained from the genes for Saccharomyces cerevisiae enolase, Saccharomyces cerevisiae cytochrome C (CYC1), and Saccharomyces cerevisiae glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice find use in the present invention. Exemplary leaders for filamentous fungal host cells are obtained from the genes for Aspergillus oryzae TAKA amylase, and Aspergillus nidulans triose phosphate isomerase. Suitable leaders for yeast host cells are obtained from the genes for Saccharomyces cerevisiae enolase (ENO-1), Saccharomyces cerevisiae 3-phosphoglycerate kinase, Saccharomyces cerevisiae alpha-factor, and Saccharomyces cerevisiae alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for Aspergillus oryzae TAKA amylase, Aspergillus niger glucoamylase, Aspergillus nidulans anthranilate synthase, Fusarium oxysporum trypsin-like protease, and Aspergillus niger alpha-glucosidase. Useful polyadenylation sequences for yeast host cells are known (See e.g., Guo and Sherman, Mol. Cell. Biol., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for Bacillus NCIB 11837 maltogenic amylase, Bacillus stearothermophilus alpha-amylase, Bacillus licheniformis subtilisin, Bacillus licheniformis beta-lactamase, Bacillus stearothermophilus neutral proteases (nprT, nprS, nprM), and Bacillus subtilis prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GAL1 system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. oryzae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. oryzae*), sC (sulfate adenyltransferase), and trpC (anthranilate synthase), as well as equivalents thereof.

In another aspect, the present invention provides a host cell comprising at least one polynucleotide encoding at least one engineered enzyme polypeptide of the present invention, the polynucleotide(s) being operatively linked to one or more control sequences for expression of the engineered enzyme enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (AfhuA) and BL21). Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or nonhomologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, or pTA1060 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3×FLAGTM™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(−) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant galactose oxidase is transformed into a host cell in order to allow propagation of the vector and expression of the variant galactose oxidase(s). In some embodiments, the variant galactose oxidases are post-translationally modified to remove the signal peptide and in some cases may be cleaved after secretion. In some embodiments, the transformed host cell described above is cultured in a suitable nutrient medium under conditions permitting the expression of the variant galactose oxidase(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved galactose oxidase polypeptide provided herein, the polynucleotide being operatively linked to one or more control sequences for expression of the galactose oxidase enzyme in the host cell. Host cells for use in expressing the galactose oxidase polypeptides encoded by the expression vectors of the present invention are well known in the art and include but are not limited to, bacterial cells, such as *E. coli, Bacillus megaterium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the galactose oxidase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. In some embodiments, the fungal host cells are yeast cells and filamentous fungal cells. The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Trametes, Tolypocladium, Trichoderma, Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida, Hansenula, Saccharomyces, Schizosaccharomyces, Pichia, Kluyveromyces*, or *Yarrowia* species. In some embodiments of the present invention, the yeast cell is

*Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans,* or *Yarrowia lipolytica.*

In some embodiments of the invention, the host cell is an algal cell such as *Chlamydomonas* (e.g., *C. reinhardtii*) and *Phormidium* (*P.* sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*. In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces,* or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an *Agrobacterium* species (e.g., *A. radiobacter, A. rhizogenes,* and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae, A. paraffineus, A. protophonniae, A. roseoparqffinus, A. sulfureus,* and *A. ureafaciens*). In some embodiments of the present invention, the bacterial host cell is a *Bacillus* species (e.g., *B. thuringensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans,* and *B. amyloliquefaciens*). In some embodiments, the host cell is an industrial *Bacillus* strain including but not limited to *B. subtilis, B. pumilus, B. licheniformis, B. megaterium, B. clausii, B. stearothermophilus,* or *B. amyloliquefaciens*. In some embodiments, the *Bacillus* host cells are *B. subtilis, B. licheniformis, B. megaterium, B. stearothermophilus,* and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens,* and *C. beijerinckii*). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the host cell is *Escherichia coli* W3110. In some embodiments, the bacterial host cell is an *Erwinia* species (e.g., *E. uredovora, E. carotovora, E. ananas, E. herbicola, E. punctata,* and *E. terreus*). In some embodiments, the bacterial host cell is a *Pantoea* species (e.g., *P. citrea,* and *P. agglomerans*). In some embodiments the bacterial host cell is a *Pseudomonas* species (e.g., *P. putida, P. aeruginosa, P. mevalonii,* and *P.* sp. D-01 10). In some embodiments, the bacterial host cell is a *Streptococcus* species (e.g., *S. equisimiles, S. pyogenes,* and *S. uberis*). In some embodiments, the bacterial host cell is a *Streptomyces* species (e.g., *S. ambofaciens, S. achromogenes, S. avermitilis, S. coelicolor, S. aureofaciens, S. aureus, S. fungicidicus, S. griseus,* and *S. lividans*). In some embodiments, the bacterial host cell is a *Zymomonas* species (e.g., *Z. mobilis,* and *Z. lipolytica*).

Many prokaryotic and eukaryotic strains that find use in the present invention are readily available to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of galactose oxidase variant(s) within the host cell and/or in the culture medium. For example, knockout of Alp1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Molec. Plant Microbe Interact., 19:7-15 [2006]; Maruyama and Kitamoto, Biotechnol Lett., 30:1811-1817 [2008]; Takahashi et al., Mol. Gen. Genom., 272: 344-352 [2004]; and You et al., Arch. Microbiol., 191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-dextran mediated transfection, PEG-mediated transformation, electroporation, or other common techniques known in the art. In some embodiments, the *Escherichia coli* expression vector pCK100900i (See, U.S. Pat. No. 9,714,437, which is hereby incorporated by reference) finds use.

In some embodiments, the engineered host cells (i.e., "recombinant host cells") of the present invention are cultured in conventional nutrient media modified as appropriate for activating promoters, selecting transformants, or amplifying the galactose oxidase polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant galactose oxidase polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant galactose oxidase(s). Several systems are commercially available and the methods are well-known to those skilled in the art.

The present invention provides methods of making variant galactose oxidase polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 2, 70, 122, 514, 426, and comprising at least one mutation as provided herein; culturing the transformed host cell in a culture medium under conditions in which the host cell expresses the encoded variant galactose oxidase polypeptide; and optionally recovering or isolating the expressed variant galactose oxidase polypeptide, and/or recovering or isolating the culture medium containing the expressed variant galactose oxidase polypeptide. In some embodiments, the methods further provide optionally lysing the transformed host cells after expressing the encoded galactose oxidase polypeptide and optionally recovering and/or isolating the expressed variant galactose oxidase polypeptide from the cell lysate. The present invention further provides methods of making a variant galactose oxidase polypeptide comprising cultivating a host cell transformed with a variant galactose oxidase polypeptide under conditions suitable for the production of the variant galactose oxidase polypeptide and recovering the variant galactose oxidase polypeptide. Typically, recovery or isolation of the galactose oxidase polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered galactose oxidase enzymes expressed in a host cell can be recovered from the cells and/or the culture medium using any one or more of the techniques known in the art for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name CelLytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001]; and Hong et al., Appl. Microbiol. Biotechnol., 73:1331 [2007], both of which are incorporated herein by reference). Indeed, any suitable purification methods known in the art find use in the present invention.

Chromatographic techniques for isolation of the galactose oxidase polypeptide include, but are not limited to reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved galactose oxidase enzymes. For affinity chromatography purification, any antibody which specifically binds the galactose oxidase polypeptide may be used. For the production of antibodies, various host animals, including but not limited to rabbits, mice, rats, etc., may be immunized by injection with the galactose oxidase. The galactose oxidase polypeptide may be attached to a suitable carrier, such as BSA, by means of a side chain functional group or linkers attached to a side chain functional group.

Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (*Bacillus* Calmette Guerin) and *Corynebacterium parvum*.

In some embodiments, the galactose oxidase variants are prepared and used in the form of cells expressing the enzymes, as crude extracts, or as isolated or purified preparations. In some embodiments, the galactose oxidase variants are prepared as lyophilisates, in powder form (e.g., acetone powders), or prepared as enzyme solutions. In some embodiments, the galactose oxidase variants are in the form of substantially pure preparations.

In some embodiments, the galactose oxidase polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify galactose oxidase variants. In one approach, antibody raised against a variant galactose oxidase polypeptide (e.g., against a polypeptide comprising any of SEQ ID NO: 2, 70, 122, 514 and/or 426, and/or an immunogenic fragment thereof) using conventional methods is immobilized on beads, mixed with cell culture media under conditions in which the variant galactose oxidase is bound, and precipitated. In a related approach, immunochromatography finds use.

In some embodiments, the variant galactose oxidases are expressed as a fusion protein including a non-enzyme portion. In some embodiments, the variant galactose oxidase sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281 [1992]) while the enterokinase cleavage site provides a means for separating the variant galactose oxidase polypeptide from the fusion protein. pGEX vectors (Promega) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Accordingly, in another aspect, the present invention provides methods of producing the engineered enzyme polypeptides, where the methods comprise culturing a host cell capable of expressing a polynucleotide encoding the engineered enzyme polypeptide under conditions suitable for expression of the polypeptide. In some embodiments, the methods further comprise the steps of isolating and/or purifying the enzyme polypeptides, as described herein.

Appropriate culture media and growth conditions for host cells are well known in the art. It is contemplated that any suitable method for introducing polynucleotides for expression of the enzyme polypeptides into cells will find use in the present invention. Suitable techniques include, but are not limited to electroporation, biolistic particle bombardment, liposome mediated transfection, calcium chloride transfection, and protoplast fusion.

Various features and embodiments of the present invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); RH (relative humidity); CV (coefficient of variability); CAM and cam (chloramphenicol); PMBS (polymyxin B sulfate); IPTG (isopropyl β-D-1-thiogalactopyranoside); LB (Luria broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the *Coli* Genetic Stock Center [CGSC], New Haven, Conn.); HTP (high throughput); HPLC (high pressure liquid chromatography); HPLC-UV (HPLC-Ultraviolet Visible Detector); 1H NMR (proton nuclear magnetic resonance spectroscopy); FIOPC (fold improvements over positive control); Sigma and Sigma-Aldrich (Sigma-Aldrich, St. Louis, Mo.); Difco (Difco Laboratories, BD Diagnostic Systems, Detroit, Mich.); Microfluidics (Microfluidics, Westwood, Mass.); Life Technologies (Life Technologies, a part of Fisher Scientific, Waltham, Mass.); Amresco (Amresco, LLC, Solon, Ohio); Carbosynth (Carbosynth, Ltd., Berkshire, UK); Varian (Varian Medical Systems, Palo Alto, Calif.); Agilent (Agilent Technologies, Inc., Santa Clara, Calif.); Infors (Infors USA Inc., Annapolis Junction, Md.); and Thermotron (Thermotron, Inc., Holland, Mich.).

Example 1

GOA Improvements Over SEQ ID NO: 2 for Enantioselective Production of EGA

The parent genes for the GOA (SEQ ID NO: 2) enzyme used to produce the variants of the present invention were codon optimized for expression in *E. coli* and synthesized and cloned into the pET-30a vector. BL21(DE3) *E. coli* cells were transformed with the respective plasmid containing the GOA-encoding genes and plated on Luria broth (LB) agar plates containing 1% glucose and 50 µg/mL kanamycin (KAN), and grown overnight at 37° C. Monoclonal colonies were picked and inoculated into 180 µL LB containing 1% glucose and 50 µg/mL KAN 96-well shallow-well microtiter plates. The plates were sealed with O$_2$-permeable seals and cultures were grown overnight at 30° C., 200 rpm and 85% relative humidity (RH). Then, 10 µL of each of the cell cultures were transferred into the wells of 96-well deep-well plates containing 390 µL TB, 50 µg/mL KAN and 0.5 mM CuSO$_4$. The deep-well plates were sealed with O$_2$-permeable seals and incubated at 30° C., 250 rpm and 85% RH until OD$_{600}$ 0.6-0.8 was reached. The cell cultures were then induced by isopropyl thioglycoside (IPTG) to a final concentration of 1 mM and incubated overnight at 25° C., 270 rpm. The cells were then pelleted using centrifugation at 4000 rpm for 10 min. The supernatants were discarded and the pellets frozen at −80° C. prior to lysis.

Frozen pellets were lysed with 200 µL lysis buffer containing 50 mM sodium phosphate (NaPi) buffer, pH 7.4, 1 mg/mL lysozyme, 0.5 mg/mL PMBS, 17 mg/ml horseradish peroxidase (HRP) and 17 mg/ml catalase. The lysis mixture was shaken at room temperature (RT) for 2.5 hours. The plate was then centrifuged for 10 min at 4000 rpm and 4° C. The supernatants were then used in biocatalytic reactions as clarified lysate to determine the activity levels.

Libraries of SEQ ID NO: 2 were produced using well-established techniques (e.g., recombination of previously identified beneficial mutations). The polypeptides encoded by each gene were produced in HTP, the clarified lysate was generated as described above.

Each 100 µL reaction was carried out in 96-well deep-well (2 mL vol.) plates with 50 µL of the clarified lysate solution, 50 g/L Compound X (2-ethynylglycerol, EGO), 50 mM NaPi buffer, 50 µM CuSO$_4$ at pH 7.4. The plates were sealed with O$_2$-permeable seals and incubated at 30° C. and agitated at 300 rpm in a 50 mm throw Infors shaker overnight maintained at 85% RH for 20 hours.

Plate wells were derivatized by taking 50 µL aliquots and adding 10 µL (R)-(+)-1-Amino-2-(methoxymethyl)pyrrolidine (R-AMP) and incubating with shaking in a 96-well round bottom (0.3 mL vol.) plate for ~30 minutes at RT. The samples were quenched by adding 200 µL acetonitrile (MeCN), shaking briefly to mix, and centrifuged at 4000 rpm at 4° C. for 5 minutes. The supernatant was transferred to a 96-well shallow-well plate and heat sealed for analysis by Analytical Method 8.1.

Variant activity relative to that of SEQ ID NO: 2 was determined by 2-ethynylglyceraldehyde (EGA) peak abundance in SIM MS (227.3 m/z) for data samples relative to the SIM MS product peak abundance of the corresponding SEQ ID NO: 2. The amount of EGA was quantified by multiplying the area of the MS product peak by a factor calculated using a standard dose-response curve of EGA on the MS using Analytical Method 8.1. The 10 samples with the highest improvement in product production were selected to be analyzed using Analytical Method 9.1 in order to identify improved enantioselectivity variants.

Enantioselectivity relative to SEQ ID NO: 2 was calculated as the enantiomeric excess with respect to the R-enantiomer of EGA (% ee R—Compound Y) formed relative to that of the corresponding SEQ ID NO: 2% ee R. Enantioselectivity was quantified by subtracting the Compound Y from the S-enantiomer of EGA (Compound Z) and dividing that difference by the sum of the R-enantiomer and S-enantiomer product peaks as determined by HPLC analysis.

TABLE 4.1

Activity and Selectivity of GOase Variants Relative to SEQ ID NO: 2

| SEQ ID NO: (nt/aa) | Amino Acid Differences (Relative to SEQ ID NO: 2) | Percent Conversion Improvement (Relative to SEQ ID NO: 2) * | Selectivity (% ee R) † |
|---|---|---|---|
| 1/2 | | + | + |
| 3/4 | K331R/F406Y/F465A | +++ | ++ |
| 5/6 | K331R/F406Y/F465Q | +++ | ++ |

TABLE 4.1

Activity and Selectivity of GOase Variants Relative to SEQ ID NO: 2

| SEQ ID NO: (nt/aa) | Amino Acid Differences (Relative to SEQ ID NO: 2) | Percent Conversion Improvement (Relative to SEQ ID NO: 2) * | Selectivity (% ee R) † |
|---|---|---|---|
| 7/8 | K331R/F406Y/E407Q/F465A | +++ | ++ |
| 9/10 | K331R/F406Y/E407Q/F465A | +++ | ++ |
| 11/12 | K331R/F406Y/F465A | +++ | ++ |

* Levels of increased activity were determined relative to the reference polypeptide of SEQ ID NO: 2, and defined as follows: "+" = 1.0 to 1.2; "++" >1.20 to 10.0; and "+++" >10.0.
† Selectivity (% ee R) was defined as follows "+" = −50.0 to 0.0; and "++" = 0.0 to 20.0.

Example 2

Preparation of Galactose Oxidase (GOA) Wet Cell Pellets

The parent genes for the GOA (SEQ ID NO: 2) enzyme used to produce the variants of the present invention were codon optimized for expression in *E. coli* and synthesized and cloned into a pCK900 vector (See e.g., U.S. Pat. No. 9,714,437, which is hereby incorporated by reference herein). W3110 *E. coli* cells were transformed with the respective plasmid containing the GOA-encoding genes and plated on LB) agar plates containing 1% glucose and 30 µg/mL CAM, and grown overnight at 37° C. Monoclonal colonies were picked and inoculated into 180 µL LB containing 1% glucose and 30 µg/mL CAM in 96-well shallow-well microtiter plates. The plates were sealed with O$_2$-permeable seals and cultures were grown overnight at 30° C., 200 rpm and 85% RH. Then, 10 µL of each of the cell cultures were transferred into the wells of 96-well deep-well plates containing 390 µL TB and 30 µg/mL CAM. The deep-well plates were sealed with 02-permeable seals and incubated at 30° C., 250 rpm and 85% RH until $OD_{600}$ 0.6-0.8 was reached. The cell cultures were then induced by IPTG to a final concentration of 1 mM and incubated overnight at 30° C., 250 rpm. The cells were then pelleted using centrifugation at 4000 rpm for 10 mM. The supernatants were discarded and the pellets frozen at −80° C. prior to lysis.

Example 3

Preparation of HTP GOA-Containing Cell Lysates

Frozen pellets prepared as specified in Example 2 were lysed with 400 μL lysis buffer containing 50 mM NaPi buffer, pH 7.4, 1 mg/mL lysozyme, 0.5 mg/mL PMBS. The lysis mixture was shaken at RT for 2 hours. The plate was then centrifuged for 15 min at 4000 rpm and 4° C. The supernatants were then used in biocatalytic reactions as clarified lysates, in experiments described below to determine the activity levels.

Example 4

Preparation of Retest GOA-Containing Cell Lysates

Frozen pellets prepared as specified in Example 2 were lysed with 150 μL lysis buffer containing 50 mM NaPi buffer, pH 7.4, 1 mg/mL lysozyme, 0.5 mg/mL PMBS. The lysis mixture was shaken at RT for 2 hours. The plate was then centrifuged for 15 min at 4000 rpm and 4° C. The supernatants were then used in biocatalytic reactions as clarified lysates in experiments described below to determine the activity levels.

Example 5

GOA Improvements Over SEQ ID NO: 4 for Enantioselective Production of Compound Y SEQ ID NO: 4 was selected as the parent enzyme for the next round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 3.

Each 100 μL reaction was carried out in 96-well deep-well (2 mL vol.) plates with 50 μL clarified lysate, 20 g/L Compound X, 50 mM NaPi buffer, 25 μM $CuSO_4$, 0.25 g/L horseradish peroxidase (HRP), 0.25 g/L catalase, at pH 7.4. The plates were sealed with $O_2$-permeable seals and incubated at 30° C. and agitated at 300 rpm in a 50 mm throw Kuhner shaker overnight maintained at 85% RH.

The variants in the plate wells were derivatized by taking 50 μL aliquots and adding 10 μL (R)-(+)-1-Amino-2-(methoxymethyl)pyrrolidine (R-AMP) and incubating with shaking in a 96-well half-deep-well (1 mL vol.) plate for ~30 minutes at RT. The samples were quenched by adding 200 μL acetonitrile (MeCN), shaking briefly to mix, and centrifuged at 4000 rpm at 4° C. for five minutes. The supernatant was transferred to a 96-well shallow-well plate and heat sealed for analysis by Analytical Method 8.1, as described in Example 8.

The activity of each variant relative to that of SEQ ID NO: 4 was calculated as the % conversion of the product (Compound Y+Z) formed per percent conversion of the corresponding SEQ ID NO: 4. Percent conversion was quantified by multiplying the area of the HPLC product peak by a factor calculated using a standard dose-response curve of Compound Y on the HPLC using Analytical Method 8.1. Variants with activity having a fold-improvement over positive control (HOP) of greater than 0.7 were selected to be analyzed using Analytical Method 9.1, as described in Example 9, in order to identify improved enantioselectivity variants.

Enantioselectivity of each variant relative to SEQ ID NO: 4 was calculated as the enantiomeric excess with respect to the Compound Y product formed relative to that of the corresponding SEQ ID NO: 4% ee R. Enantioselectivity was quantified by subtracting Compound Y from Compound Z and dividing that difference by the sum of Y and Z product peaks as determined by HPLC analysis. The results are provided below.

TABLE 5.1

Activity and Selectivity of GOase Variants Relative to SEQ ID NO: 4

| SEQ ID NO: (nt/aa) | Amino Acid Differences (Relative to SEQ ID NO: 4) | Percent Conversion Improvement (Relative to SEQ ID NO: 4)* | Selectivity (% ee R) † |
|---|---|---|---|
| 13/14 | I463K | | +++ |
| 15/16 | E407V | | +++ |
| 17/18 | L204S | + | +++ |
| 19/20 | G197K | | +++ |
| 21/22 | T520V | ++ | +++ |
| 23/24 | I202T | | +++ |
| 25/26 | R191A | + | +++ |
| 27/28 | G517S | | +++ |
| 29/30 | P199T | ++ | +++ |
| 31/32 | I463V | | +++ |
| 33/34 | T520L | | +++ |
| 35/36 | G517L | ++ | +++ |
| 37/38 | F296A | ++ | +++ |
| 39/40 | P199G | | +++ |
| 41/42 | E466R | | +++ |
| 43/44 | V220P | | +++ |
| 45/46 | G517D | + | +++ |
| 47/48 | A324G | | +++ |
| 49/50 | V220E | +++ | ++ |
| 51/52 | T243V | +++ | ++ |
| 53/54 | N192I | ++ | ++ |
| 55/56 | A248T | ++ | ++ |
| 57/58 | T205A | + | ++ |
| 59/60 | G294N | +++ | ++ |
| 61/62 | G517E | ++ | ++ |
| 63/64 | L515T | ++ | ++ |
| 65/66 | D247G | + | ++ |
| 67/68 | L204Q | + | ++ |
| 69/70 | F296W | + | ++ |
| 71/72 | N522S | + | ++ |
| 73/74 | T243C | + | ++ |
| 75/76 | A173S | + | ++ |
| 77/78 | A173C | + | ++ |
| 79/80 | A248E | ++ | ++ |
| 81/82 | D193T | +++ | ++ |
| 83/84 | T521S | + | ++ |
| 85/86 | P199R | + | ++ |
| 87/88 | V269Q | + | ++ |
| 89/90 | A465G | ++ | ++ |
| 91/92 | I70L | ++ | ++ |
| 93/94 | V220R | + | ++ |
| 95/96 | S198A | + | ++ |
| 97/98 | N192Q | + | + |
| 99/100 | V171A | + | + |
| 101/102 | T521V | + | + |
| 103/104 | T520P | ++ | + |
| 105/106 | A324S | + | + |
| 107/108 | F296S | + | + |

TABLE 5.1-continued

Activity and Selectivity of GOase Variants Relative to SEQ ID NO: 4

| SEQ ID NO: (nt/aa) | Amino Acid Differences (Relative to SEQ ID NO: 4) | Percent Conversion Improvement (Relative to SEQ ID NO: 4)* | Selectivity (% ee R) † |
|---|---|---|---|
| 109/110 | I463R | + | + |
| 111/112 | S252T | + | + |
| 113/114 | S198T | ++ | + |
| 115/116 | T520G | + | + |
| 117/118 | F296L | + | + |
| 119/120 | T520S | + | + |
| 121/122 | N192M | ++ | + |
| 123/124 | V171L | ++ | + |
| 125/126 | T521G | ++ | + |
| 127/128 | G294K | + | + |
| 129/130 | V493G | + | + |
| 131/132 | G294S | +++ | + |
| 133/134 | V171C | +++ | + |
| 135/136 | S198G | +++ | + |
| 137/138 | M227L | ++ | + |
| 139/140 | G517M | ++ | + |
| 141/142 | L204V | + | + |
| 143/144 | I202C | + | + |
| 145/146 | A194V | + | + |
| 147/148 | V269Y | + | + |
| 149/150 | T521P | + | + |
| 151/152 | S332R | + | + |
| 153/154 | G197S | ++ | + |

*Levels of increased activity were determined relative to the reference polypeptide of SEQ ID NO: 4, and defined as follows: "+" >1.2 but less than 1.8; "++" >1.8 but less than 2.5; and "+++" >2.5.
† Selectivity (% ee R) was defined as follows: "+" = 0.0 but less than 15.0; "++" = 15.0 but less than 20.0; and "+++" = 20.0 but less than 40.0.

Example 6

GOA Improvements Over SEQ ID NO: 4 for Enantioselective Production of Compound Y SEQ ID NO: 4 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 50 μL clarified lysate, 20 g/L Compound X, 50 mM NaPi buffer, 25 μM CuSO$_4$, 0.25 g/L HRP, 0.25 g/L catalase, at pH 7.4. The plates were sealed with O$_2$-permeable seals and incubated at 30° C. and agitated at 300 rpm in a 50 mm throw Kuhner shaker overnight maintained at 85% RH.

The enzyme variants in the plate wells were derivatized by taking 50 μL aliquots and adding 10 μL R-AMP and incubating with shaking in a 96-well half-deep-well plate for ~30 minutes at RT. The samples were quenched by adding 200 μL MeCN, shaking briefly to mix, and centrifuged at 4000 rpm at 4° C. for five minutes. The supernatant was transferred to a 96-well shallow-well plate and heat sealed for analysis by Analytical Method 8.1.

The activity of each enzyme variant relative to that of SEQ ID NO: 4 was calculated as the % conversion of the product (Compound Y+Z)) formed per percent conversion of the corresponding SEQ ID NO: 4. Percent conversion was quantified by multiplying the area of the HPLC product peak by a factor calculated using a standard dose-response curve of Compound Y on the HPLC using Analytical Method 8.1.

Variants with activity having a FIOP of greater than 0.7 were selected to be analyzed using Analytical Method 9.1 in order to identify improved enantioselectivity variants.

Enantioselectivity of each variant relative to SEQ ID NO: 4 was calculated as the % ee R EGA with respect to the % ee R EGA formed of the corresponding SEQ ID NO: 4 as in Example 5. The results are provided below.

TABLE 6.1

Variant GOase Activity and Selectivity Relative to SEQ ID NO: 4

| SEQ ID NO: (nt/aa) | Amino Acid Differences (Relative to SEQ ID NO: 4) | Percent Conversion Improvement (Relative to SEQ ID NO: 4)* | Selectivity (% ee R) † |
|---|---|---|---|
| 155/156 | V295N | | +++ |
| 157/158 | V295G | | +++ |
| 159/160 | A465T | | +++ |
| 161/162 | E407M | | +++ |
| 163/164 | S252R | | +++ |
| 165/166 | V295R | | +++ |
| 167/168 | V295E | | +++ |
| 169/170 | E407I | | +++ |
| 171/172 | V295S | | +++ |
| 173/174 | T223N | | +++ |
| 175/176 | E407F | | +++ |
| 177/178 | S252V | | +++ |
| 179/180 | T223L | | +++ |
| 181/182 | A465M | | +++ |
| 183/184 | V220P | | +++ |
| 185/186 | G517K | | +++ |
| 187/188 | S252M | | +++ |
| 189/190 | S332Q | | +++ |
| 191/192 | T223H | ++ | +++ |
| 193/194 | V220C | + | +++ |
| 195/196 | T223M | | +++ |
| 197/198 | A173S | + | +++ |
| 199/200 | S252T | + | ++ |
| 201/202 | T521Y | + | ++ |
| 203/204 | V220S | + | ++ |
| 205/206 | A465G | + | ++ |
| 207/208 | T203V | + | ++ |
| 209/210 | P199S | + | ++ |
| 211/212 | T243A | + | ++ |
| 213/214 | G197S | + | ++ |
| 215/216 | G294E | + | ++ |
| 217/218 | T521A | + | ++ |
| 219/220 | V220E | ++ | + |
| 221/222 | T521V | + | + |
| 223/224 | T243S | + | + |
| 225/226 | F296S | + | + |
| 227/228 | V171A | + | + |
| 229/230 | G197T | + | + |
| 231/232 | L515V | + | + |
| 233/234 | P199N | + | + |
| 235/236 | G294Q | + | + |
| 237/238 | G294S | + | + |
| 239/240 | V220M | + | + |
| 241/242 | E466R | + | + |
| 243/244 | P199A | + | + |
| 245/246 | T521Q | + | + |
| 247/248 | T521G | ++ | + |
| 249/250 | E466G | + | + |
| 251/252 | T520A | + | + |
| 253/254 | G517S | + | + |
| 255/256 | S188T | + | + |
| 257/258 | G197K | + | + |
| 259/260 | N192Q | + | + |
| 261/262 | G517D | + | + |
| 263/264 | T520S | + | + |
| 265/266 | V493T | + | + |

*Levels of increased activity were determined relative to the reference polypeptide of SEQ ID NO: 4, and defined as follows: "+" = 1.2 but less than 1.8; "++" = 1.8 but less than 2.5"; and "+++" >2.5.
† Selectivity (% ee R) was defined as follows: "+" = 0.0 but less than 15.0; "++" = 15.0 but less than 20.0; and "+++" = 20.0 but less than 40.0.

Example 7

GOA Improvements Over SEQ ID NO: 166 for Enantioselective Production of Compound Y SEQ ID NO: 166 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 45 μL clarified lysate, 20 g/L Compound X, 50 mM NaPi buffer, 50 μM $CuSO_4$, 0.25 g/L HRP, 0.25 g/L catalase, at pH 7.4. The plates were sealed with $O_2$-permeable seals and incubated at 30° C. and agitated at 300 rpm in a 50 mm throw Kuhner shaker overnight maintained at 85% RH.

The enzyme variants in the plate wells were derivatized by taking 50 μL aliquots and adding 10 μL R-AMP and incubating with shaking in a 96-well half-deepwell plate for ~30 minutes at RT. In the case of samples analyzed by Analytical Method 10.1 (as described in Example 10), the samples were quenched by adding 60 μL of ethanol followed by mixing, and further followed by transferring 20 μL of the diluted samples into a 96-well shallow-well plate containing 120 μL of water. The plates were briefly agitated and were then analyzed.

In the case of samples analyzed by Analytical Method 8.1, the samples were quenched by adding 200 μL MeCN, shaking briefly to mix, and centrifuged at 4000 rpm at 4° C. for five minutes. The supernatant was transferred to a 96-well shallow-well plate and heat sealed for analysis.

The activity of each variant relative to that of SEQ ID NO: 166 was calculated as ultraviolet (UV) absorbance at 247 nm of the RAMP-derived product formed per $UV_{247}$ absorbance of the corresponding SEQ ID NO: 166 using Analytical Method 10.1. Variants with activity having a FIOP of greater than 0.75 were selected to be analyzed using Analytical Method 9.1 (Example 9), in order to identify improved enantioselectivity variants.

Enantioselectivity of each variant relative to SEQ ID NO: 166 was calculated as the % ee R EGA with respect to the % ee R EGA formed of the corresponding SEQ ID NO: 166 as in Example 5.

TABLE 7.1

Enzyme Variant Activity and Selectivity Relative to SEQ ID NO: 166

| SEQ ID NO: (nt/aa) | Amino Acid Differences (Relative to SEQ ID NO: 166) | Percent Conversion Improvement (Relative to SEQ ID NO: 166)* | Selectivity (% ee R) † |
|---|---|---|---|
| 267/268 | V220E/S252V/S332Q/E407I | | +++ |
| 269/270 | V220S/F296V/S332Q/E407V | | +++ |
| 271/272 | V220S/F296V/A465T | | +++ |
| 273/274 | V220E/E407I | | +++ |
| 275/276 | V171C/V220S/S332Q/E407V | | +++ |
| 277/278 | V220S/F296V/S332Q/E407V/T520A/T521G | | +++ |
| 279/280 | V171L/R295E/F296V/S332Q/A465T | | +++ |
| 281/282 | V220E/E407I | | +++ |
| 283/284 | F296V/S332Q/E407V/T520A | | +++ |
| 285/286 | V220E/F296V/E407V | | +++ |
| 287/288 | S332Q/E407I | | +++ |
| 289/290 | S332Q/E407V | | +++ |
| 291/292 | E407Q/A465T | | +++ |
| 293/294 | V220E/R295E/F296V/A465T/T520A | + | +++ |
| 295/296 | V171L/F296V/E407I | | +++ |
| 297/298 | V220E/R295E/F296V/S332Q/E407V/T520A | + | +++ |
| 299/300 | V171C/F296V/E407V/A465T | | +++ |
| 301/302 | S332Q/E407V/T521G | | +++ |
| 303/304 | V220E/E407V | | +++ |
| 305/306 | V220E/T243V/E407I | | +++ |
| 307/308 | V220E/T243V/R295E/F296V/S332Q/E407V/T521G | | +++ |
| 309/310 | V220E/T243V/E407V/A465T | | +++ |
| 311/312 | V220S/R295E/E407I/T521G | | ++ |
| 313/314 | S332Q/E407V/T520A/T521G | | ++ |
| 315/316 | V220S/E407I | | ++ |
| 317/318 | F296V/S332Q/E407V/T521G | | ++ |
| 319/320 | V171C/V220S/T243V/E407Q/A465T | | ++ |
| 321/322 | V220C/A465G/G517R | | ++ |
| 323/324 | R295E/S332Q/E407V/T521G | | ++ |
| 325/326 | E407I | | ++ |
| 327/328 | V220S/R295G/E407I/T520A/T521G | | ++ |
| 329/330 | V220S/R295G/F296V/S332Q | | ++ |
| 331/332 | L204A/T243A/A465G/G517R/T521Q | | ++ |
| 333/334 | A277T/F296V/E407I/T520A/T521G | | ++ |
| 335/336 | V220S/R295E/F296V/S332Q/E407Q/T521G | | ++ |
| 337/338 | V220S/R295G/F296V/E407V | | ++ |
| 339/340 | R295G/F296V/E407I/T521G | | ++ |
| 341/342 | V220E/A465T/T520A | + | ++ |
| 343/344 | V220E/E407V/T520A | | ++ |
| 345/346 | V220S/R295G/F296V/S332Q/E407I/A465T/T521G | | ++ |
| 347/348 | E407V/T520A | | ++ |
| 349/350 | A173S/A465G | | ++ |
| 351/352 | R295E/S332Q/E407V/A465T | | ++ |
| 353/354 | V171C/V220E/E407V | | ++ |
| 355/356 | G294E/F296S/E407M | | ++ |
| 357/358 | E407I/T520A | | ++ |
| 359/360 | A173S/N192Q/T243A/A465G | + | ++ |
| 361/362 | V220E/R295G/E407V/A465T | | ++ |
| 363/364 | V220M/R295E/A465T/T520A | + | ++ |
| 365/366 | E407V | | ++ |
| 367/368 | V220S/F296V/A465T/T521G | | ++ |
| 369/370 | V220S/R295E/S332Q/A465T/T520A/T521G | | ++ |

TABLE 7.1-continued

Enzyme Variant Activity and Selectivity Relative to SEQ ID NO: 166

| SEQ ID NO: (nt/aa) | Amino Acid Differences (Relative to SEQ ID NO: 166) | Percent Conversion Improvement (Relative to SEQ ID NO: 166)* | Selectivity (% ee R) † |
|---|---|---|---|
| 371/372 | V220E/S332Q/E407Q/A465T/T521G | | ++ |
| 373/374 | V220M/T243V/E407V/T520A/T521G | | ++ |
| 375/376 | R295E/E407I | | ++ |
| 377/378 | V171L/V220E/A465T/T520A | | ++ |
| 379/380 | T243V/R295E/E407I | | ++ |
| 381/382 | R295E/F296V/E407Q | | ++ |
| 383/384 | V171C/V220M/F296V/E407V/T520A | | ++ |
| 385/386 | V220E/T243V/R295G/F296V/E407V | | ++ |
| 387/388 | N192T/V220E/E407V | | ++ |
| 389/390 | V171C/E407V/T520A | | ++ |
| 391/392 | R295E/F296V/S332Q/E407I | | ++ |
| 393/394 | T221I/M227N/T243A/A465G | | ++ |
| 395/396 | V220C/A465G | | ++ |
| 397/398 | V220S/T243V/E407Q/T520A/T521G | | ++ |
| 399/400 | V220S/R295E/F296V | + | ++ |
| 401/402 | G294S/A465G/L515V | | ++ |
| 403/404 | V171C/S332Q | | ++ |
| 405/406 | R295E/S332Q/T520A/T521G | + | ++ |
| 407/408 | V220S/F296V | + | ++ |
| 409/410 | N192T/V220E/R295E/F296V/S332Q/T521G | | ++ |
| 411/412 | A465G/L515V | + | ++ |
| 413/414 | V171C/E407V | | ++ |
| 415/416 | V220M/R295E/S332Q | | ++ |
| 417/418 | V284I/R295E/F296V | + | ++ |
| 419/420 | V171C/T243V/F296V/S332Q | | ++ |
| 421/422 | N192T/V220M/F296V/S332Q/T520A | + | ++ |
| 423/424 | A465G/G517H/T521Q | | ++ |
| 425/426 | S198R/R295S/F296S | | ++ |
| 427/428 | V220E/R295E/A465T/T521G | + | ++ |
| 429/430 | V171C/V220E/R295E/F296V/E407Q | | ++ |
| 431/432 | A465G/L515V/G517R/T521Q | | ++ |
| 433/434 | R295E/F296V | | ++ |
| 435/436 | R295E/F296V/T521G | + | ++ |
| 437/438 | F296V/T520A/T521G | + | ++ |
| 439/440 | A465M | | ++ |
| 441/442 | G294S/A465G | | ++ |
| 443/444 | G294S/T521Q | | ++ |
| 445/446 | V171C/R295E/S332Q | | ++ |
| 447/448 | F296S/E407M | | ++ |
| 449/450 | A173S | | ++ |
| 451/452 | N192T/R295G/F296V/S332Q | | ++ |
| 453/454 | V220E | | ++ |
| 455/456 | M227N | | ++ |
| 457/458 | N192Q/G294S/A465G/L515V | | ++ |
| 459/460 | T243A/L515V/G517R | | ++ |
| 461/462 | F296V | | ++ |
| 463/464 | S198R/R295N | | ++ |
| 465/466 | S198A/G294E/F296S | | ++ |
| 467/468 | V220S/T243V | + | + |
| 469/470 | L204S | + | + |
| 471/472 | G517N | + | + |
| 473/474 | N192T/R295E/F296V | + | + |
| 475/476 | N192T/F296V | + | + |
| 477/478 | T243V/R295E | + | + |
| 479/480 | N192T/R295G/F296V/T520A/T521G | + | + |
| 481/482 | N192T/V220E/R295E/T520A/T521G | + | + |

*Levels of increased activity were determined relative to the reference polypeptide of SEQ ID NO: 166, and defined as follows: "+" = 1.2 but less than 1.8; "++" = 1.8 but less than 2.5; and "+++" >2.5.
† Selectivity (% ee R) is defined as follows: "+" = 20.0 but less than 40.0; "++" = 40.0 but less than 60.0; and "+++" = 60.0 but less than 80.0.

Example 8

Analytical Detection of R-AMP-Derived 2-Ethynylglyceraldehyde

Data described in Examples 1, 5, 6, 7, 11, 14 and 16 were collected using the analytical method in Table 8.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 8.1

Analytical Method

| | |
|---|---|
| Instrument | Thermo Vanquish UPLC with UV and/or MS Detection |
| Column | Waters Cortecs C18, 2.1 × 50 mm, 1.6 µm |
| Mobile Phase | A: water, 0.01% formic acid; B: MeCN. |
| Gradient | 2-40% B over 1.0 min; 40-80% B over 0.7 min. |
| Flow Rate | 0.8 mL/min |
| Run Time | ~2.3 min |
| Product Elution | 2-ethynylgluteraldehyde: 0.9 min |
| Column Temperature | 50° C. |
| Injection Volume | 0.5 µL |
| Detection | UV 247 nm; SIM MS 227.3 m/z |

Example 9

Analytical Detection of Enantiomers of R-AMP-Derived 2-Ethynylglyceraldehyde Data described in Examples 1, 5, 6, 7, 11, 14, 15, 17 and 18 were collected using the analytical method provided in Table 9.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 9.1

Analytical Method

| | |
|---|---|
| Instrument | Agilent 1290 - UPLC |
| Column | ChiralPak OZ-3, 4.6 × 150 mm (PN# 42524) |

TABLE 9.1-continued

| Analytical Method | |
|---|---|
| Mobile Phase | A: heptane, 0.1% diethylamine (v/v); B: ethanol. |
| Gradient | Isocratic at 27% B. |
| Flow Rate | 1.7 mL/min |
| Run Time | 4.0 min |
| Product Elution order | R-2-ethynylglyceraldehyde: ~2.6 min |
| | S-2-ethynylglyceraldehyde: ~3.1 min |
| Column Temperature | 30° C. |
| Injection Volume | 1.2 µL |
| Detection | UV 247 nm |

Example 10

Spectrophotometric Analytical Detection of R-AMP-Derived 2-Ethynylglyceraldehyde Data described in Example 7 were collected using the analytical method provided in Table 10.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 10.1

| Analytical Method | |
|---|---|
| Instrument | Molecular Devices Spectramax M2 |
| Analysis Plate | Greiner Bio-one, "UV-Star" 96-well Plate, Microplate, COC, F-Bottom, Chimney Well. |
| Sample Volume | 200 µL |
| Detection | UV: 247 nm |
| Temperature | Room Temperature |

Example 11

GOA Improvements Over SEQ ID NO: 272 for Enantioselective Production of Compound Y SEQ ID NO: 272 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 50 µL clarified lysate, 20 g/L Compound X, 50 mM NaPi buffer, 25 µM $CuSO_4$, 0.25 g/L HRP, 0.25 g/L catalase, at pH 7.4. The plates were sealed with $O_2$-permeable seals and incubated at 30° C. and agitated at 300 rpm in a 50 mm throw Kuhner shaker overnight maintained at 85% RH.

The enzyme variants in the plate wells were derivatized by taking 50 µL aliquots and adding 10 µL of 100 g/L solution in water of R-AMP and incubating with shaking in a 96-well half-deep-well plate for ~30 minutes at RT. The samples were quenched by adding 200 µL MeCN, shaking briefly to mix, and centrifuged at 4000 rpm at 4° C. for five minutes. The supernatant was transferred to a 96-well shallow-well plate and heat sealed for analysis by Analytical Method 8.1.

The activity of each enzyme variant relative to that of SEQ ID NO: 272 was calculated as the % conversion of the product (Compound Y+Z)) formed per percent conversion of the corresponding SEQ ID NO: 272. Percent conversion was quantified by multiplying the area of the HPLC product peak by a factor calculated using a standard dose-response curve of Compound Y on the HPLC using Analytical Method 8.1. Variants with activity having a FIOP of greater than 0.7 were selected to be analyzed using Analytical Method 9.1 in order to identify improved enantioselectivity variants.

Enantioselectivity of each variant relative to SEQ ID NO: 272 was calculated as the % ee R EGA with respect to the % ee R EGA formed of the corresponding SEQ ID NO: 272 as in Example 5. The results are provided below.

TABLE 11.1

Enzyme Variant Activity and Selectivity Relative to SEQ ID NO: 272

| SEQ ID NO: (nt/aa) | Amino Acid Differences (Relative to SEQ ID NO: 272) | Percent Conversion Improvement (Relative to SEQ ID NO: 272)* | Selectivity (% ee R) † |
|---|---|---|---|
| 483/484 | S220E; R295E; T520A | + | +++ |
| 485/486 | S220E; R295E; T521G | + | +++ |
| 487/488 | N192Q; T243S | ++ | +++ |
| 489/490 | T465G | + | +++ |
| 491/492 | A16S | ++ | +++ |
| 493/494 | R295T | ++ | +++ |
| 495/496 | Q553S | + | +++ |
| 497/498 | V222D | ++ | +++ |
| 499/500 | N29Y | + | +++ |
| 501/502 | M279T | + | +++ |
| 503/504 | S426L | + | +++ |
| 505/506 | A16E | ++ | +++ |
| 507/508 | S426A | + | +++ |
| 509/510 | V222T | + | +++ |
| 511/512 | S220E | + | +++ |
| 513/514 | R295E | ++ | +++ |
| 515/516 | S24E | + | +++ |

TABLE 11.1-continued

Enzyme Variant Activity and Selectivity Relative to SEQ ID NO: 272

| SEQ ID NO: (nt/aa) | Amino Acid Differences (Relative to SEQ ID NO: 272) | Percent Conversion Improvement (Relative to SEQ ID NO: 272)* | Selectivity (% ee R) † |
|---|---|---|---|
| 517/518 | Y56I | ++ | +++ |
| 519/520 | Q148A | ++ | +++ |
| 521/522 | S92V | + | +++ |
| 523/524 | S24A | ++ | +++ |
| 525/526 | E196D | + | +++ |
| 527/528 | S304C | + | +++ |
| 529/530 | V296T | + | +++ |
| 531/532 | S24P | ++ | +++ |
| 533/534 | T63V | ++ | +++ |
| 535/536 | V222Y | ++ | +++ |
| 537/538 | S257D | + | +++ |
| 539/540 | R560W | ++ | +++ |
| 541/542 | R637L | ++ | +++ |
| 543/544 | I499F | ++ | +++ |
| 545/546 | S24Q | + | +++ |
| 547/548 | A46V | + | +++ |
| 549/550 | Q148R | + | +++ |
| 551/552 | I499V | + | +++ |
| 553/554 | K36P | ++ | +++ |
| 555/556 | R549G | + | +++ |
| 557/558 | S8V | + | +++ |
| 559/560 | S258L | + | +++ |
| 561/562 | V296E | ++ | +++ |
| 563/564 | S363E | + | +++ |
| 565/566 | N134H | + | +++ |
| 567/568 | F43Q | ++ | +++ |
| 569/570 | N597D | + | +++ |
| 571/572 | A4Q | + | +++ |
| 573/574 | S567M | + | +++ |
| 575/576 | S103I | + | +++ |
| 577/578 | A194E | + | +++ |
| 579/580 | R549Q | + | +++ |
| 581/582 | R295S | + | +++ |
| 583/584 | R295Q | + | +++ |
| 585/586 | F43A | ++ | +++ |
| 587/588 | N319S | ++ | +++ |
| 589/590 | S24P; F43A; Q148A; S363L | + | |
| 591/592 | S24P; Q148A; N319S; T465F; R637L | + | |
| 593/594 | S24P; K36P; S92D; V222D; R560W; R637L | + | |
| 595/596 | S24P; F43A; S92D; M279L; I499F | + | |
| 597/598 | S24P; R637L | + | |
| 599/600 | S24P; K36P; S363L; T465F; R637L | + | |
| 601/602 | K36P; S92D; Q148A; M279L; N319S; S363L; R560W; R637L | + | |
| 603/604 | F43A; S92D; Q148A; V222D; M279L; I499F; R560W | + | |
| 605/606 | S24P; K36P; F43A; Q148A; N319R; R560W; R637L | + | |
| 607/608 | S24P; Q148A; R637L | + | |
| 609/610 | S24P; F43A; Q148A; R295E; R560W | + | |
| 611/612 | K36P; S92D; R560W | + | |
| 613/614 | K36P; V222D; M279L; N319S; S363L; R560W | + | |
| 615/616 | S24P; K36P; Q148A; V222D; M279L; R560W; R637L | + | |
| 617/618 | K36P; S92D; Q148A; I499F; R637L | + | |
| 619/620 | K36P; F43Q; S92D; Q148A; V222D; M279L; R295D; I499F; R560W; R637L | + | |
| 621/622 | F43A; V222D; M279L | + | |
| 623/624 | S24P; K36P; S92D; M279L; N319R; S363L; R637L | + | |
| 625/626 | M279L; R560W; R637L | + | |
| 627/628 | K36P; Q148A; V222D; N319S; T465F; I499F | + | |
| 629/630 | S24P; S92D; Q148A; M279L; S363L | + | |
| 631/632 | S24P; K36P; S92D; Q148A | + | |
| 633/634 | K36P; S92D; N319R; S363L; R637L | + | |
| 635/636 | F43Q; S92D; V222Y; T465F; I499F; R637L | + | |
| 637/638 | S24P; S92D; M279L; S363L; T465F; I499F; R560W; R637L | + | |
| 639/640 | S92D; Q148A; R295E; N319S; T465F; R637L | + | |
| 641/642 | S92D; M279L; T465F; R637L | + | |
| 643/644 | S24P; F43A; Q148A; R560W | + | |
| 645/646 | S24P; K36P | + | |

TABLE 11.1-continued

Enzyme Variant Activity and Selectivity Relative to SEQ ID NO: 272

| SEQ ID NO: (nt/aa) | Amino Acid Differences (Relative to SEQ ID NO: 272) | Percent Conversion Improvement (Relative to SEQ ID NO: 272)* | Selectivity (% ee R) † |
|---|---|---|---|
| 647/648 | F43A; Q148A; M279L; R295D; R560W | + | |
| 649/650 | S24P; F43A; V222D | + | |
| 651/652 | S24P; F43Q; S92D; M279L; S363L; R560W; R637L | + | |
| 653/654 | A16S; S24A; F43E; Y56F; S103I; S220E; R295T; V296L; I499V; R549W | + | |
| 655/656 | F43E; Q148R; R549W | + | |
| 657/658 | A16S; F43E; Y56F; S103I; Q148R; S220E; R295S; V296E; I499V; R549W | + | |
| 659/660 | A16S; R295Q; V296E; S426L; I499V; R549W | + | |
| 661/662 | A16S; T63V; S103I; S220E; R295Q; S426L; R549W | + | |
| 663/664 | Q148R; R295Q; T465F | + | |
| 665/666 | A16S; Q148R; S220E; V296E; R549W | + | |
| 667/668 | S220E; V296E; S304C; S426L; R549W | + | |
| 669/670 | A16S; F43E; S103I; Q148R; S220E; R295Q; S426L; R549W | + | |
| 671/672 | A16E; Q148R; S220E; R295T; S426L; I499V; R549W | + | |
| 673/674 | A16S; Q148R; S220E; R295Q; V296E; S304C; I499V | + | |
| 675/676 | A16S; Y56F; V296E | + | |
| 677/678 | A16S; Y56F; T63V; Q148R; R295T; V296E; S304C; S426L | + | |
| 679/680 | A16E; S220E; I499V | + | |
| 681/682 | A16S; F43E; Q148R; S220E; R295S; I499V | + | |
| 683/684 | A16E; S103I; S220E; T465F | + | |
| 685/686 | A16S; F43E; R295T; V296E; R549W | + | |
| 687/688 | A16E; R295Q; S426L; T465F; I499V; R549W | + | |
| 689/690 | F43E; Y56F; S220E; V296E; S426L; I499V; R549W | + | |
| 691/692 | A16S; F43E; T63V; S103I; R295Q; S304C; I499V; R549W | + | |
| 693/694 | A16E; S103I; S220E; V296E; T465F; R549W | + | |
| 695/696 | F43E; R295Q; I499V | + | |
| 697/698 | A16E; Y56F; S426L; I499V | + | |
| 699/700 | F43E; Y56F; S220E; S426L; R549W | + | |
| 701/702 | A16S; F43E; T63V; Q148R; R295Q; I499V | + | |
| 703/704 | A16E; F43E; S426L; R549W | + | |
| 705/706 | A16S; Q148R; R295Q; S426L; R549W | + | |
| 707/708 | S8I; S258L; S363E; S426P; Q553S; N597D | + | |
| 709/710 | S8I; N29T; S92V; E196D; S258L; S426P | + | |
| 711/712 | S8I; A46V; S92V; M279T; V296T; S426P; R549G; Q553S; N597D | + | |
| 713/714 | S363E; S426P; Q481D; Q553S | + | |
| 715/716 | S8I; S92V; S258L; S363E; R549G; Q553S; S567M | + | |
| 717/718 | E196D; S258L; S363E; S426P; T465F; R549G; N597D | + | |
| 719/720 | N29T; A46V; S92V; E196D; S258L; M279T; S363E; S426P; Q481D; S567M; N597D | + | |
| 721/722 | A46V; E196D; F228W; M279T; V296T; T465F; Q553S | + | |
| 723/724 | S8V; N192Q; R460A; R560T; N598E | + | |
| 725/726 | S8V; Y56I; N192Q; A194G; R460Q; K571A; N598E | + | |
| 727/728 | S8V; N192Q; A194E; T243S; R460Q; Q553S; R560T | + | |
| 729/730 | S8V; Y56I; T243S; R560T; N598E | + | |

*Levels of increased activity were determined relative to the reference polypeptide of SEQ ID NO: 272 and defined as follows: "+" 1.2 to 1.8, "++" 1.8 to 2.5, "+++" >2.5
† Selectivity (% ee) was defined as follows: "+" 20.0 to 40.0, "++" 40.0 to 60.0, "+++" 60.0 to 80.0

Example 12

GOA Improvements Over SEQ ID NO: 272 for Enantioselective Production of Compound Y SEQ ID NO: 272 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 50 µL clarified lysate, 20 g/L Compound X, 50 mM NaPi buffer, 25 µM $CuSO_4$, 0.25 g/L HRP, 0.25 g/L catalase, at pH 7.4. The plates were sealed with $O_2$-permeable seals and incubated at 30° C. and agitated at 300 rpm in a 50 mm throw Kuhner shaker overnight maintained at 85% RH.

The enzyme variants in the plate wells were derivatized by taking 50 µL aliquots and adding 10 µL of 100 mg/mL solution in water of R-AMP and incubating with shaking in a 96-well half-deepwell plate for ~30 minutes at RT. In the case of samples analyzed by Analytical Method 20.1 (as described in Example 20), the samples were quenched by adding 60 µL of ethanol followed by mixing, and further followed by transferring 20 µL of the diluted samples into a 96-well shallow-well plate containing 120 µL of water. The plates were briefly agitated and were then analyzed.

The activity of each variant relative to that of SEQ ID NO: 272 was calculated as ultraviolet (UV) absorbance at 340 nm of the RAMP-derived product formed per $UV_{340}$ absorbance of the corresponding SEQ ID NO: 272 using Analytical Method 20.1.

TABLE 12.1

Enzyme Variant Activity and Selectivity Relative to SEQ ID NO: 272

| SEQ ID NO: (nt/aa) | Amino Acid Differences (Relative to SEQ ID NO: 272) | Percent Conversion Improvement (Relative to SEQ ID NO: 272)* |
|---|---|---|
| 731/732 | S24P; S92D; V222D; M279L; N319S; R637L | ++ |
| 731/732 | S24P; S92D; V222D; M279L; N319S; R637L | ++ |
| 733/734 | F43Q; Q148A; V222D; M279L; R560W; R637L | + |
| 735/736 | N319R; R637L | + |
| 737/738 | Q148A; M279L; N319S; I499F | + |
| 739/740 | Q148A; V222D | + |
| 741/742 | S24P; K36P; S92D; M279L; R295E; S363L; I499F | + |
| 743/744 | S24P; S92D | + |
| 745/746 | S24P; F43A; V222Y; N319R | ++ |
| 747/748 | S24P; F43A; S92D; Q148A; M279L; R295D; N319S; R637L | + |
| 749/750 | N319S; R560W | + |
| 751/752 | M279L; R560W; R637L | ++ |
| 753/754 | R295D; I499F; R560W; R637L | ++ |
| 755/756 | S24P; F43A; S92D; V222Y; M279L | + |
| 757/758 | S92D; V222D; M279L; I499F; R560W; R637L | ++ |
| 759/760 | S24P; F43A; S363L; R637L | ++ |
| 761/762 | K36P; S92D; V222D; R637L | ++ |
| 763/764 | K36P; F43Q; V222Y; M279L; S363L; R560W | + |
| 765/766 | S24P; M279L; N319R | + |
| 767/768 | Q148A; V222D; R560W; R637L | ++ |
| 769/770 | K36P; Q148A; M279L; N319S; I499F | + |
| 771/772 | S363L; R560W | + |
| 773/774 | K36P; S92D; Q148A; V222D; M279L; N319S; S363L; I499F; R560W; R637L | ++ |
| 775/776 | S24P; S92D; Q148A; M279L | + |
| 777/778 | S24P; V222D; R637L | ++ |
| 779/780 | S92D | + |
| 781/782 | Q148R; S220E; S304C | + |
| 783/784 | A16E; T63V; Q148R; S220E; R295Q; V296E; S426L; I499V | + |
| 785/786 | A16E; Q148R; R295Q; R549W | + |
| 787/788 | A16S; F43E; Q148R; V296E; S426L; I499V | ++ |
| 789/790 | T63V; S103I; Q148R; S220E; R295S; R549W | + |
| 791/792 | A16S; T63V; S103I; Q148R; S426L; I499V; R549W | + |
| 793/794 | A16E; Y56F; Q148R; R295Q; V296E; S304C; S426L; R549W | + |
| 795/796 | A16S; S103I; Q148R; S220E; I499V | + |
| 797/798 | F43E; S220E; R295S; R549W | ++ |
| 799/800 | A16S; T63V; S103I; S426L; I499V; R549W | + |
| 801/802 | T63V; S220E; R295T; S304C; S426L; I499V; R549W | ++ |
| 803/804 | A16S; T63V; Q148R; I499V; R549W | + |
| 805/806 | A16E; F43E; S103I; S304C; I499V; R549W | + |
| 807/808 | R295S; V296E; R549W | + |
| 809/810 | S103I; R295T; I499V; R549W | + |
| 811/812 | A16S; Y56F; R295T; I499V | + |
| 813/814 | A16E; Q148R; S426L; R549W | ++ |
| 815/816 | A16S; Y56F; S103I; S220E; R295S | ++ |
| 817/818 | A16S; S103I; Q148R; R295S; S426L; I499V; R549W | + |
| 819/820 | A16S; S103I; Q148R | + |
| 821/822 | A16E; S103I; S220E; R295Q | ++ |
| 823/824 | T63V; S220E; R295T; S304C; R549W | ++ |
| 825/826 | A16S; F43E; Q148R; R295Q; V296E; S304C; I499V; R549W | ++ |
| 827/828 | A16E; Y56F; S103I; R295T; R549W | + |
| 829/830 | A16S; S103I | + |
| 831/832 | A16E; Q148R; R295Q; S426L | + |
| 833/834 | A16E; S304C; I499V; R549W | + |
| 835/836 | A16S; S304C; S426L; I499V | + |
| 837/838 | Y56F; Q148R; S220E; R295Q; I499V | + |
| 839/840 | A16E; Y56F; S103I; S220E; R295T; V296E | + |
| 841/842 | A16E; F43E; S103I; Q148R; R295Q; S426L; I499V; R549W | + |
| 843/844 | S220E; R295T; R549W | + |
| 845/846 | A16E; Q148R; S220E; R295S; S426L; I499V | + |
| 847/848 | A16S; F43E; T63V; S103I; R295Q; V296E; I499V | + |
| 849/850 | A16S; Y56F; S220E; I499V; R549W | ++ |
| 851/852 | A16E; S220E; R295Q; V296E | + |
| 853/854 | R295Q; V296E; S426L; R549W | + |
| 855/856 | A16E; F43E; R295T; V296E; I499V | + |
| 857/858 | A16S; Y56F; S220E; R295S | ++ |
| 859/860 | A16E; Y56F; R295Q; V296E; R549W | + |
| 861/862 | A16S; Y56F; R295Q | + |
| 863/864 | A16S; Y56F; I499V; R549W | + |
| 865/866 | N29Y; S426P; R549G | + |
| 867/868 | S8I; N29Y; A46V; E196D; S363E; Q481D; R549G; Q553S | ++ |
| 869/870 | S8I; S92V; E196D; Q481D; N597D | ++ |
| 871/872 | S92V; S258L; S363E; S426P; Q481D; R549G; N597D | + |

TABLE 12.1-continued

Enzyme Variant Activity and Selectivity Relative to SEQ ID NO: 272

| SEQ ID NO: (nt/aa) | Amino Acid Differences (Relative to SEQ ID NO: 272) | Percent Conversion Improvement (Relative to SEQ ID NO: 272)* |
|---|---|---|
| 873/874 | V296T; S363E; S426P; Q481D; R549G | + |
| 875/876 | N29T; R549G; Q553S | + |
| 877/878 | S8I; S258L; S363E; S426P; R549G | + |
| 879/880 | N29T; A46V; Q481D; R549G; Q553S; N597D | + |
| 881/882 | M279T; V296T; Q481D; R549G; Q553S; S567M; N597D | + |
| 883/884 | S8I; S92V; E196D; S258L; S426P; N597D | + |
| 885/886 | N29T; A46V; S92V; E196D; S426P; Q481D; R549G; N597D | + |
| 887/888 | S8I; E196D; S258L; M279T; Q481D; R549G; Q553S | + |
| 889/890 | S8I; M279T; S363E; S426P; Q481D; R549G; Q553S | ++ |
| 891/892 | A194E; T243S; L329A; R560T; K571A; N598E | + |
| 893/894 | S8V; Y56I; N192Q; T243S; N598E | + |
| 895/896 | S8V; Y56I; N192Q; A194E; T243S; R460A; R560T; N598E | + |
| 897/898 | A194G; T243S; L329A; R460Q | + |
| 899/900 | S8V; S257D; R460Q; R560T; N598E | + |
| 901/902 | S8V; Y56I; N192Q; A194E; T243S; L329A; R460A; R560T | ++ |
| 903/904 | S8V; Y56I | + |
| 905/906 | A4Q; Y56I; N192Q; A194G; S257N; K571A; N598E | + |
| 907/908 | S8V; Y56I; N192Q; T243S; R460Q | ++ |
| 909/910 | Y56I; T243S | ++ |
| 911/912 | S8V; Y56I; N192Q; A194G; T243S; L329A | + |
| 913/914 | S8V; N192Q; A194G; T243S; L329A; R460Q; R560T | + |
| 915/916 | Y56I; A194G; T243S; S257N; L329A; R460A | + |
| 917/918 | S8V; T243S; R460Q; R560T; K571A; N598L | ++ |
| 919/920 | A4Q; Y56I; A194E; L329A; N598E | + |
| 921/922 | A4Q; A194G; T243S; R549G; N598E | + |
| 923/924 | A4Q; S8V; Y56I; N598L | ++ |
| 925/926 | S8V; Y56I; A194G; S257D; R460A; R549G; R560T; N598L | ++ |

*Levels of increased activity were determined relative to the reference polypeptide of SEQ ID NO: 272 and defined as follows: "+" 1.2 to 1.8, "++" 1.8 to 2.5, "+++" >2.5

Example 13

GOA Improvements Over SEQ ID NO: 928 for Enantioselective Production of Compound Y In this round of directed evolution the strep tag was removed from the C-terminus of SEQ ID NO: 908 and a His-tag added. The resulting sequence SEQ ID NO: 928 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 10 µL clarified lysate, 30 g/L Compound X, 50 mM MES buffer, 200 µM $CuSO_4$, 0.20 g/L HRP, 0.20 g/L catalase, at pH 7.4. The plates were sealed with 02-permeable seals and incubated at 30° C. and agitated at 300 rpm in a 50 mm throw Kuhner shaker overnight maintained at 85% RH.

The enzyme variants in the plate wells were derivatized by taking 50 µL aliquots and adding 10 µL of 100 mg/mL solution in water of R-AMP and incubating with shaking in a 96-well half-deepwell plate for ~30 minutes at RT. In the case of samples analyzed by Analytical Method 20.1 (as described in Example 20), the samples were quenched by adding 60 µL of ethanol followed by mixing, and further followed by transferring 20 µL of the diluted samples into a 96-well shallow-well plate containing 120 µL of water. The samples were further diluted to make a 100-fold final dilution in the analysis plate. The plates were briefly agitated and were then analyzed.

The activity of each variant relative to that of SEQ ID NO: 928 was calculated as ultraviolet (UV) absorbance at 340 nm of the RAMP-derived product formed per $UV_{340}$ absorbance of the corresponding SEQ ID NO: 928 using Analytical Method 20.1.

TABLE 13.1

Enzyme Variant Activity and Selectivity Relative to SEQ ID NO: 928

| SEQ ID NO: (nt/aa) | Amino Acid Differences (Relative to SEQ ID NO: 928) | Percent Conversion Improvement (Relative to SEQ ID NO: 928)* |
|---|---|---|
| 927/928 | / | / |
| 929/930 | A4Q; F43Q; A46V; S426L; R549G; R560W | + |
| 931/932 | F43Q; A46V; T63V; S258L; R295Q; S426L; R560W; S567M; K571A | + |
| 933/934 | F43Q; A46V; E196D; N319S; R549G; R560W; S567M | + |
| 935/936 | F43Q; A46V; I56F; Q148A; S258L; M279L; S363L; R549G; K571A | + |
| 937/938 | F43Q; M279L; R549G; R560W; S567M | + |
| 939/940 | R295Q; R549G; R560W | + |

TABLE 13.1-continued

Enzyme Variant Activity and Selectivity Relative to SEQ ID NO: 928

| SEQ ID NO: (nt/aa) | Amino Acid Differences (Relative to SEQ ID NO: 928) | Percent Conversion Improvement (Relative to SEQ ID NO: 928)* |
|---|---|---|
| 941/942 | A4Q; F43Q; A46V; I56F; T63V; M279L; R295T; N319S; S567M; N598E | + |
| 943/944 | A4Q; F43Q; Q148A; E196D; M279L; N319S; S363L; R560W | + |
| 945/946 | A46V; R560W | + |
| 947/948 | R549G; N598E | + |
| 949/950 | M279L; N319S; R560W | + |
| 951/952 | A4Q; F43Q; A46V; R295Q; N319S; R549G; R560W | + |
| 953/954 | A46V; R295T; N319S; S426L | + |
| 955/956 | A16S; S92D; Q192N; M279T; R637L | + |
| 957/958 | A16E; K36P; Q192N; R549W; N597D; N598L; R637L | + |
| 959/960 | A16E; F43E; I56V; Q192N; R549W; N597D; N598L; R637L | + |
| 961/962 | A16S; M279T; R549W; N597D; N598L; R637L | + |
| 963/964 | A16E; M279T; N319R; R549W; N597D; R637L | + |
| 965/966 | A16E; N29T; S92D; S220E; V222D; N319R; R549W; N598L | + |
| 967/968 | A16E; F43E; N597D | ++ |
| 969/970 | A16E; N597D | + |
| 971/972 | A16E; Q192N; R549W | + |
| 973/974 | A16E; Q192N; N319R; R549W; R637L | + |
| 975/976 | A16E | + |
| 977/978 | A16E; K36P; F43A; Q192N; N597D; R637L | ++ |
| 979/980 | K36P; S92D; R549W | + |
| 981/982 | A16E; N29Y; S92D; N319R; R549W | + |
| 983/984 | A16E; S220E; V222D; M279T; R549W; N598L; R637L | + |
| 985/986 | A16E; F43E; Q192N; R549W | ++ |
| 987/988 | A16E; N29Y; F43E; Q192N; V222D; N319R; R549W; R637L | + |
| 989/990 | A16E; F43E; M279T; N319R; N597D | ++ |
| 991/992 | A16E; N29T; S220E; V222D; M279T; R549W; R637L | + |
| 993/994 | A16E; S24P; F43E; S92D; R549W | ++ |
| 995/996 | A16E; N29Y; S220E; V222D; N597D; N598L | + |
| 997/998 | A16E; N29Y; Q192N; R549W | ++ |
| 999/1000 | A16E; N29T; Q192N; S220E; R549W; N597D | + |
| 1001/1002 | A16E; S24P; N29Y | + |
| 1003/1004 | A16E; F43A; M279T; R549W; N597D | ++ |
| 1005/1006 | A16E; N29Y; Q192N; V222D; M279T; R549W | + |
| 1007/1008 | A16S; S92D; N319R; N597D; R637L | + |
| 1009/1010 | A16E; F43A; S220E; R549W; R637L | ++ |
| 1011/1012 | A16E; S220E; M279T; R549W | + |
| 1013/1014 | S220E; V222D; N597D; R637L | + |
| 1015/1016 | A16E; N319R; N597D | + |
| 1017/1018 | A16E; N29T; Q192N; R549W | + |
| 1019/1020 | A16E; M279T; N597D | + |
| 1021/1022 | A16E; S92D; S220E; R549W | + |
| 1023/1024 | A16E; S92D; Q192N; M279T; N319R; R549W; R637L | + |
| 1025/1026 | A16S; N29Y; S92D; Q192N; R549W; R637L | + |
| 1027/1028 | A16E; S24P; F43E; Q192N; S220E; M279T; R549W | ++ |
| 1029/1030 | A16E; N29T; F43A; S92D; Q192N; N319R | + |
| 1031/1032 | A16E; N29T; K36P; Q192N; N319R; R549W; N597D; N598L; R637L | + |
| 1033/1034 | A16E; N29T; K36P; M279T; R549W | + |
| 1035/1036 | A16E; N29Y; R549W; R637L | + |
| 1037/1038 | A16E; N29T; S92D; M279T; R549W | + |
| 1039/1040 | A16E; S24P; N29T; M279T; R549W | + |
| 1041/1042 | A16E; R549W | + |
| 1043/1044 | A16E; S220E; N319R; R549W; N597D; N598L | + |
| 1045/1046 | A16E; N319R; N597D; N598L | + |
| 1047/1048 | A16E; K36P; N319R; R549W; N597D; N598L; R637L | + |
| 1049/1050 | A16E; S24P; N29T; S92D; S220E; M279T; N597D; N598L | + |
| 1051/1052 | A16E; N29T; F43E; V222D; M279T; R549W | ++ |
| 1053/1054 | A16E; R549W; N598L | + |
| 1055/1056 | A16E; V222D; N319R; N597D; N598L | + |
| 1057/1058 | A16E; V222D; R637L | + |
| 1059/1060 | A16S; N29T; S92D; R549W; R637L | + |
| 1061/1062 | A16E; F43A; S92D; V222D; N597D; N598L | + |
| 1063/1064 | A16E; K36P; S92D; S220E; V222D; M279T; R549W | + |
| 1065/1066 | A16E; N29T; V222D; R549W; N598L; R637L | + |
| 1067/1068 | A16E; N29T; Q192N; S220E; R549W | + |
| 1069/1070 | A16E; S24P; N29T; M279T; R637L | + |
| 1071/1072 | A16E; N29T; Q192N; V222D; R637L | + |
| 1073/1074 | A16S; F43E; N319R; R549W; N598L | ++ |
| 1075/1076 | S220E; V296S ; E407I; T465G | + |
| 1077/1078 | G294E | + |
| 1079/1080 | T520A; N597D; N598E | + |
| 1081/1082 | N29H; N597D; N598E | + |
| 1083/1084 | N237D; T520A; N538D; N597D | + |
| 1085/1086 | N29H; T63V; T520A; S537G; N538D; N598E | + |

TABLE 13.1-continued

Enzyme Variant Activity and Selectivity Relative to SEQ ID NO: 928

| SEQ ID NO: (nt/aa) | Amino Acid Differences (Relative to SEQ ID NO: 928) | Percent Conversion Improvement (Relative to SEQ ID NO: 928)* |
|---|---|---|
| 1087/1088 | N237D; T520A; S567M; K571A; N597D | ++ |
| 1089/1090 | N237D; T520A; N597D; N598E | ++ |
| 1091/1092 | N237D; T520A; S537G; N598E | + |
| 1093/1094 | S567M; K571A; N597D | + |
| 1095/1096 | N237D; N538D; N597D; N598E | + |
| 1097/1098 | N29H; N237D; S567M; N598E | + |
| 1099/1100 | N29H; N237D; T520A; N538D | + |
| 1101/1102 | N134A; T520A; N597D; N598E | + |
| 1103/1104 | N29H; N237D; N597D | + |
| 1105/1106 | K36V; T520A; S537G; N538D; N597D | + |
| 1107/1108 | K36V; N134A; N237D; S567M; K571A; N597D; N598E | + |
| 1109/1110 | N29H; N134A; N237D; S537G; N538D; S567M; K571A | + |
| 1111/1112 | N29H; N237D; T520A | + |
| 1113/1114 | K36V; N134A; N237D; T520A; S537G; N538D; K571A | + |
| 1115/1116 | N237D; K571A | + |
| 1117/1118 | N237D; T520A | + |
| 1119/1120 | N237D; N597D; N598E | + |
| 1121/1122 | N134A; N237D; T520A; N597D | + |
| 1123/1124 | T520A; K571A; N598E | + |
| 1125/1126 | N29H; T63V; N134A; T520A; N597D; N598E | + |
| 1127/1128 | N237D; T520A; S537G; N538D; N598E | + |
| 1129/1130 | T483R | ++ |
| 1131/1132 | S568E | + |
| 1133/1134 | K486P | + |
| 1135/1136 | K556A | + |
| 1137/1138 | K556V | + |
| 1139/1140 | S568P | + |
| 1141/1142 | S564W | + |
| 1143/1144 | T95E | + |
| 1145/1146 | T465G | + |
| 1147/1148 | S564D | + |
| 1149/1150 | S564E | + |
| 1151/1152 | S609D | + |
| 1153/1154 | S433G | ++ |
| 1155/1156 | K224D | + |
| 1157/1158 | S564T | + |
| 1159/1160 | K343G | + |
| 1161/1162 | K556S | + |

*Levels of increased activity were determined relative to the reference polypeptide of SEQ ID NO: 928 and defined as follows: "+" 1.2 to 1.8, "++" 1.8 to 2.5, "+++" >2.5

Example 14

GOA Improvements Over SEQ ID NO: 928 for Enantioselective Production of Compound Y SEQ ID NO: 928 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 15 µL clarified lysate 21 g/L Compound X, 9 g/L Compound Y, 50 mM MES buffer, 200 µM $CuSO_4$, 0.20 g/L HRP, 0.20 g/L catalase, at pH 7.4. The plates were sealed with $O_2$-permeable seals and incubated at 30° C. and agitated at 300 rpm in a 50 mm throw Kuhner shaker overnight maintained at 85% RH.

The enzyme variants in the plate wells were diluted 3-fold with acetonitrile by adding 20 uL of the reaction to a 96-well shallow-well plate containing 40 uL of acetonitrile. 20 uL of this 3-fold diluted reaction was derivatized by adding 10 uL of 100 g/L solution in acetonitrile of R-AMP and incubating with shaking in a 96-well half-deepwell plate for ~45 minutes at 30° C. The samples were quenched by adding 170 µL MeCN, shaking briefly to mix, and centrifuged at 4000 rpm at 4° C. for five minutes. The supernatant was transferred to a 96-well shallow-well plate and heat sealed for analysis by Analytical Method 8.1 (Table 14.1) or 9.1 (Table 14.2).

TABLE 14.1

Enzyme Variant Activity and Selectivity Relative to SEQ ID NO: 928

| SEQ ID NO: (nt/aa) | Amino Acid Differences (Relative to SEQ ID NO: 928) | Percent Conversion Improvement (Relative to SEQ ID NO: 928)* |
|---|---|---|
| 1163/1164 | A4Q; F43Q; A46V; S426L; R549G; R560W | +++ |
| 1165/1166 | T520A; N597D | + |
| 1167/1168 | K36V; T63V; T520A | + |
| 1169/1170 | N598E | + |
| 1171/1172 | K556 | ++ |
| 1173/1174 | T562D | + |
| 1175/1176 | T483R | ++ |
| 1177/1178 | S568D | + |
| 1179/1180 | T95V | + |

TABLE 14.1-continued

Enzyme Variant Activity and Selectivity
Relative to SEQ ID NO: 928

| SEQ ID NO: (nt/aa) | Amino Acid Differences (Relative to SEQ ID NO: 928) | Percent Conversion Improvement (Relative to SEQ ID NO: 928)* |
|---|---|---|
| 1181/1182 | S568P | + |
| 1183/1184 | K394A | + |

*Levels of increased activity were determined relative to the reference polypeptide of SEQ ID NO: 928 and defined as follows: "+" 1.2 to 1.8, "++" 1.8 to 2.5, "+++" >2.5

TABLE 14.2

Enzyme Variant Activity and Selectivity
Relative to SEQ ID NO: 928

| SEQ ID NO: (nt/aa) | Amino Acid Differences (Relative to SEQ ID NO: 928) | Selectivity (% ee R) † |
|---|---|---|
| 1185/1186 | G294E; E407M; T465G | +++ |
| 1187/1188 | S220M; G294E; T465G | +++ |
| 1189/1190 | S220E; G294E; V296S; S332Q | +++ |
| 1191/1192 | E407V; T465G | +++ |
| 1193/1194 | V638A | +++ |
| 1195/1196 | T63A; E196L | +++ |
| 1197/1198 | G197R | +++ |
| 1199/1200 | A194R | +++ |
| 1201/1202 | E196A | +++ |
| 1203/1204 | S198T; V447I | +++ |
| 1205/1206 | G197Q | +++ |
| 1207/1208 | G197P | +++ |
| 1209/1210 | E196R | +++ |
| 1211/1212 | E196L | +++ |
| 1213/1214 | A194W | +++ |
| 1215/1216 | S290G | +++ |
| 1217/1218 | G197A | +++ |
| 1219/1220 | Q327R | +++ |
| 1221/1222 | S198G | +++ |
| 1223/1224 | A173V | +++ |
| 1225/1226 | E196G | +++ |
| 1227/1228 | S189A | +++ |
| 1229/1230 | S290A | +++ |
| 1231/1232 | S292G | +++ |
| 1233/1234 | E196Q | +++ |
| 1235/1236 | E196V | +++ |
| 1237/1238 | E196I | +++ |
| 1239/1240 | A194V | +++ |
| 1241/1242 | S198T | +++ |
| 1243/1244 | A173S | +++ |
| 1245/1246 | G197E | +++ |

† Selectivity (% ee) was defined as follows: "+" 20.0 to 40.0, "++" 40.0 to 60.0, "+++" 60.0 to 80.0

Example 15

GOA Improvements Over SEQ ID NO: 932 for Enantioselective Production of Compound Y SEQ ID NO: 932 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 7.5 μL clarified lysate from total lysate volume of 200 uL, 30 g/L Compound X, 50 mM MES buffer, 200 μM CuSO$_4$, 5 g/L HRP, 0.2 g/L catalase, at pH 7.4. The plates were sealed with O$_2$-permeable seals and incubated at 30° C. and agitated at 300 rpm in a 50 mm throw Kuhner shaker overnight maintained at 85% RH The enzyme variants in the plate wells were diluted 3-fold with acetonitrile by adding 20 uL of the reaction to a 96-well shallow-well plate containing 40 uL of acetonitrile. 20 uL of this 3-fold diluted reaction was derivatized by adding 10 uL of 100 g/L solution in acetonitrile of R-AMP and incubating with shaking in a 96-well half-deepwell plate for ~45 minutes at 30° C. The samples were quenched by adding 1704 MeCN, shaking briefly to mix, and centrifuged at 4000 rpm at 4° C. for five minutes. The supernatant was transferred to a 96-well shallow-well plate and heat sealed for analysis by Analytical Method 9.1.

Enantioselectivity of each variant relative to SEQ ID NO: 932 was calculated as the % ee R EGA with respect to the % ee R EGA formed of the corresponding SEQ ID NO: 932 as in Example 5. The results are provided below.

TABLE 15.1

Enzyme Variant Activity and Selectivity
Relative to SEQ ID NO: 932

| SEQ ID NO: (nt/aa) | Amino Acid Differences (Relative to SEQ ID NO: 932) | Selectivity (% ee R) † |
|---|---|---|
| 1247/1248 | A16E; Q43A; S220M; L258S; N538D; R637L | +++ |
| 1249/1250 | A16E; L258S; L426S; T465G; N538D; R549W; R637L | +++ |
| 1251/1252 | Q43A; L258S; E407I; L426S; T465G; N538D; R549W; R637L | ++++ |
| 1253/1254 | S220M; G294E; Q295S; N319S; E407I; L426S; T465G; N538D; R549W; R637L | ++++ |
| 1255/1256 | L258S; N538D; R549W; R637L | ++++ |
| 1257/1258 | L258S; M267T | ++++ |
| 1259/1260 | L258S; N319S; L426S; T465G; R549W; R637L | +++ |
| 1261/1262 | V63T; T95E; A173S; K343G; S564D; S568P; S609D | +++ |
| 1263/1264 | T95V; A173S; L258S; L426S; K556V; S564W | ++++ |
| 1265/1266 | L258S; L426S | +++ |
| 1267/1268 | A173S; K556V | ++++ |
| 1269/1270 | T95E; A173S; K556V; S609D | ++++ |
| 1271/1272 | V63T | +++ |
| 1273/1274 | T18K | ++++ |
| 1275/1276 | S24P; V222D; T520A | +++ |
| 1277/1278 | V222D; T520A; N597D | +++ |
| 1279/1280 | Q43E; V222D; N237D; L258S; L426S; N597D | +++ |
| 1281/1282 | V222D; N237D | +++ |
| 1283/1284 | N237D; L258S; R549G; N597D | ++++ |
| 1285/1286 | N237D; P265S; M279L | ++++ |
| 1287/1288 | S24P; V222D; N237D; T520A; N538D | +++ |
| 1289/1290 | A194R | ++++ |

† Selectivity (% ee) was defined as follows: "+" 20.0 to 40.0, "++" 40.0 to 60.0, "+++" 60.0 to 80.0, "++++" 80.0 to 90.0

Example 16

GOA Improvements Over SEQ ID NO: 1264 for Enantioselective Production of Compound Y SEQ ID NO: 1264 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4, except a 300 ul per well lysis volume was used.

Each 100 μL reaction was carried out in 96-well deep-well plates with 50 μL clarified lysate from a 300 uL lysis total volume, 18 g/L Compound X, 12 g/L Compound Y, ~80 mM NaPi buffer, 200 μM CuSO$_4$, 0.20 g/L HRP, 0.20 g/L catalase, at pH 7.4. The plates were sealed with O$_2$-permeable seals and incubated at 30° C. and agitated at 300 rpm in a 50 mm throw Kuhner shaker overnight maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of R-AMP and incubating with shaking in a 96-well half-deepwell plate for ~45 minutes at 30° C. The samples were quenched by adding 200 μL MeCN, shaking briefly to mix, and centrifuged at 4000 rpm at 4° C. for five minutes. The supernatant was transferred to a 96-well shallow-well plate and heat sealed for analysis by Analytical Method 8.1.

TABLE 16.1

Enzyme Variant Activity and Selectivity Relative to SEQ ID NO: 1264

| SEQ ID NO: (nt/aa) | Amino Acid Differences (Relative to SEQ ID NO: 1264) | Percent Conversion Improvement (Relative to SEQ ID NO: 1264)* |
|---|---|---|
| 1291/1292 | Q43E; N237D; T520A; N597D | + |
| 1293/1294 | Q43E | + |
| 1295/1296 | Q43E; M279L; G294E | + |
| 1297/1298 | R549G | + |
| 1299/1300 | Q43E; N237D; M279L; N538D; N597D; N598E | + |
| 1301/1302 | Q43E; N237D; G294E; N538D | + |
| 1303/1304 | Q43E; R549G; N597D | + |
| 1305/1306 | Q43E; N237D; T520A; R549G; N598E | + |
| 1307/1308 | Q43E; N538D | + |
| 1309/1310 | Q43E; N237D; T520A | + |
| 1311/1312 | N237D; T520A; N538D; N597D | + |
| 1313/1314 | K51P; T55W; T111Q; S150P; K367I; W564D | + |
| 1315/1316 | K367I; K371D; W564D; T594Q | + |
| 1317/1318 | T18K; V95E; Q327R; T548M | + |
| 1319/1320 | V95E; Q327R; T548M | + |
| 1321/1322 | S258H | + |
| 1323/1324 | C229S | + |
| 1325/1326 | K371A | + |
| 1327/1328 | S243K | + |
| 1329/1330 | K342R | ++ |
| 1331/1332 | T635K | + |
| 1333/1334 | S468N | + |
| 1335/1336 | S604M | + |
| 1337/1338 | R549E | + |
| 1339/1340 | S568A | + |
| 1341/1342 | K371P | + |
| 1343/1344 | K342S | + |
| 1345/1346 | F291V | + |
| 1347/1348 | K36N | + |
| 1349/1350 | S312T | + |
| 1351/1352 | R183D | + |
| 1353/1354 | K224G | + |
| 1355/1356 | T520N | + |
| 1357/1358 | C384G | + |
| 1359/1360 | K61E | + |
| 1361/1362 | T55M | + |
| 1363/1364 | S570K | + |
| 1365/1366 | T520E | + |
| 1367/1368 | W564K; S604G | + |
| 1369/1370 | R637N | + |
| 1371/1372 | Q295T | + |
| 1373/1374 | S99H | + |
| 1375/1376 | M567G | + |
| 1377/1378 | C28S | + |

TABLE 16.1-continued

Enzyme Variant Activity and Selectivity Relative to SEQ ID NO: 1264

| SEQ ID NO: (nt/aa) | Amino Acid Differences (Relative to SEQ ID NO: 1264) | Percent Conversion Improvement (Relative to SEQ ID NO: 1264)* |
|---|---|---|
| 1379/1380 | R637W | + |
| 1381/1382 | Q43F; V46A; I56Y; V63T; R191V | + |
| 1383/1384 | R544P | + |
| 1385/1386 | K343S | + |
| 1387/1388 | T55R | + |
| 1389/1390 | C28P | + |
| 1391/1392 | S243L | + |
| 1393/1394 | Y485L | + |
| 1395/1396 | H335R | + |
| 1397/1398 | T594C | + |
| 1399/1400 | S252G | + |
| 1401/1402 | S198R | + |
| 1403/1404 | T596G | + |

*Levels of increased activity were determined relative to the reference polypeptide of SEQ ID NO: 1264 and defined as follows: "+" 1.2 to 1.8, "++" 1.8 to 2.5, "+++" >2.5

Example 17

GOA Improvements Over SEQ ID NO: 1264 for Enantioselective Production of Compound Y SEQ ID NO: 1264 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4, except a 200 uL per well lysis volume was used.

Each 100 μL reaction was carried out in 96-well deep-well plates with 10 μL clarified lysate from a 200 uL lysis total volume, 30 g/L Compound X, ~100 mM NaPi buffer, 200 μM CuSO$_4$, 5 g/L HRP, 0.20 g/L catalase, at pH 7.4. The plates were sealed with 02-permeable seals and incubated at 30° C. and agitated at 300 rpm in a 50 mm throw Kuhner shaker overnight maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of R-AMP and incubating with shaking in a 96-well half-deepwell plate for ~45 minutes at 30° C. The samples were quenched by adding 200 μL MeCN, shaking briefly to mix, and centrifuged at 4000 rpm at 4° C. for five minutes. The supernatant was transferred to a 96-well shallow-well plate and heat sealed for analysis by Analytical Method 9.1.

TABLE 17.1

Enzyme Variant Activity and Selectivity Relative to SEQ ID NO: 1264

| SEQ ID NO: (nt/aa) | Amino Acid Differences (Relative to SEQ ID NO: 1264) | Selectivity (% ee R) † |
|---|---|---|
| 1405/1406 | C28P | ++++ |
| 1407/1408 | S99H; T520E; R637N | ++++ |
| 1409/1410 | C28P; S99H; T520E; R637N | ++++ |
| 1411/1412 | S403P; T520E; R637N | ++++ |

TABLE 17.1-continued

Enzyme Variant Activity and Selectivity
Relative to SEQ ID NO: 1264

| SEQ ID NO: (nt/aa) | Amino Acid Differences (Relative to SEQ ID NO: 1264) | Selectivity (% ee R) † |
|---|---|---|
| 1413/1414 | S99H; R637N | ++++ |
| 1415/1416 | K224G; T520E; R637N | ++++ |
| 1417/1418 | K61E; K224G; K343S; T520E; R637N | ++++ |
| 1419/1420 | S99H; K343S; R637N | ++++ |
| 1421/1422 | T520E; R637N | ++++ |
| 1423/1424 | K343S; T520E; R637N | ++++ |
| 1425/1426 | R637W | ++++ |
| 1427/1428 | Q295T; K342S; S568A | ++++ |
| 1429/1430 | T594C | ++++ |
| 1431/1432 | T55R; S568A | ++++ |
| 1433/1434 | K342S; S568A | ++++ |
| 1435/1436 | K342S; T594C | ++++ |
| 1437/1438 | T55R; S568A; R637W | ++++ |
| 1439/1440 | T55R; S568A; T594C | ++++ |
| 1441/1442 | S568A; R637W | ++++ |
| 1443/1444 | T55R; K342S | ++++ |
| 1445/1446 | Q295T; K342S | ++++ |
| 1447/1448 | T55R; Q295T | +++ |

† Selectivity (% ee) was defined as follows: "+" 20.0 to 40.0, "++" 40.0 to 60.0, "+++" 60.0 to 80.0, "++++" 80.0 to 99.0

Example 18

GOA Improvements Over SEQ ID NO: 1416 for Enantioselective Production of Compound Y SEQ ID NO: 1416 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4, except a 200 uL per well lysis volume was used.

Each 100 μL reaction was carried out in 96-well deep-well plates with 40 μL clarified lysate from a 200 uL lysis total volume, 30 g/L Compound X, ~200 mM NaPi buffer, 200 μM CuSO₄, 0.2 g/L HRP, 0.20 g/L catalase, at pH 6.5. The plates were heat sealed and incubated at 30° C. and agitated at 300 rpm for 4 hours in a 50 mm throw Kuhner shaker maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of R-AMP and incubating with shaking in a 96-well half-deepwell plate for ~45 minutes at 30° C. The samples were quenched by adding 200 μL MeCN, shaking briefly to mix, and centrifuged at 4000 rpm at 4° C. for five minutes. The supernatant was transferred to a 96-well shallow-well plate and heat sealed for analysis by Analytical Method 9.1.

TABLE 18.1

Enzyme Variant Activity and Selectivity
Relative to SEQ ID NO: 1416

| SEQ ID NO: (nt/aa) | Amino Acid Differences (Relative to SEQ ID NO: 1416) | Selectivity (% ee R) † |
|---|---|---|
| 1449/1450 | Q274G | ++++ |
| 1451/1452 | A439G | ++++ |
| 1453/1454 | Y437 | ++++ |
| 1455/1456 | Y437C | ++++ |
| 1457/1458 | Q156V | ++++ |
| 1459/1460 | T429V | ++++ |
| 1461/1462 | Y437V | ++++ |
| 1463/1464 | I262V | ++++ |
| 1465/1466 | A336P | ++++ |
| 1467/1468 | N375L | ++++ |
| 1469/1470 | F605L | ++++ |
| 1471/1472 | N35D | ++++ |
| 1473/1474 | L253V | ++++ |
| 1475/1476 | V393T | ++++ |
| 1477/1478 | I561S | ++++ |
| 1479/1480 | N488L | ++++ |
| 1481/1482 | A354D | ++++ |
| 1483/1484 | G200 | ++++ |
| 1485/1486 | S105R | ++++ |
| 1487/1488 | V478L | ++++ |
| 1489/1490 | A627R | ++++ |
| 1491/1492 | G45V | ++++ |
| 1493/1494 | S568K | ++++ |
| 1495/1496 | V393G | ++++ |
| 1497/1498 | P380H | ++++ |
| 1499/1500 | A154H | ++++ |
| 1501/1502 | Q156L | ++++ |
| 1503/1504 | N13H | ++++ |
| 1505/1506 | Q239M | ++++ |
| 1507/1508 | L595W | ++++ |
| 1509/1510 | N315G | ++++ |
| 1511/1512 | Y359F | +++ |
| 1513/1514 | G328K | ++++ |
| 1515/1516 | Q274N | ++++ |
| 1517/1518 | V393D | ++++ |
| 1519/1520 | V366T | +++ |
| 1521/1522 | Q373T | +++ |
| 1523/1524 | Y437R | +++ |
| 1525/1526 | P380R | +++ |
| 1527/1528 | V241I | ++++ |
| 1529/1530 | V393P | +++ |
| 1531/1532 | P380L | ++++ |
| 1533/1534 | D37M | ++++ |
| 1535/1536 | D37Y | ++++ |
| 1537/1538 | A354T | ++++ |
| 1539/1540 | V478M | ++++ |
| 1541/1542 | P263S | ++++ |
| 1543/1544 | G559S | ++++ |
| 1545/1546 | D37I | ++++ |
| 1547/1548 | Y89R | ++++ |
| 1549/1550 | F438S | ++++ |
| 1551/1552 | I561T | ++++ |
| 1553/1554 | L541R | ++++ |
| 1555/1556 | G328R | ++++ |
| 1557/1558 | Y437G | ++++ |
| 1559/1560 | N488T | ++++ |
| 1561/1562 | T550S | ++++ |
| 1563/1564 | N13K | ++++ |
| 1565/1566 | G328L | ++++ |
| 1567/1568 | D217P | ++++ |
| 1569/1570 | T441I | ++++ |
| 1571/1572 | P380K | ++++ |
| 1573/1574 | N13A; Q156V; I262V; N315G; T429V; Y437V | ++++ |
| 1575/1576 | Q274G; Y359F | ++++ |
| 1577/1578 | I262V; Q274G; Y437R | ++++ |
| 1579/1580 | Q274G; Y437V; S568K | ++++ |
| 1581/1582 | N13A; Q274G | ++++ |
| 1583/1584 | N26M; I262V; Q274G; N315G; Y437R | ++++ |
| 1585/1586 | Q156V; Q274G; N315G | ++++ |
| 1587/1588 | N13A; N26M; Q156V; Q274G; Y359F; T429V | ++++ |
| 1589/1590 | I262V; Q274G; N315G | ++++ |
| 1591/1592 | N13A; Q156L; I262V; Q274G; N315G | ++++ |
| 1593/1594 | N13A; Q156L; Q274G; Y437K; S568K; Q606S | ++++ |

TABLE 18.1-continued

Enzyme Variant Activity and Selectivity
Relative to SEQ ID NO: 1416

| SEQ ID NO: (nt/aa) | Amino Acid Differences (Relative to SEQ ID NO: 1416) | Selectivity (% ee R) † |
|---|---|---|
| 1595/1596 | N13A; Q274G; N315G; Y437V | ++++ |
| 1597/1598 | Q274N; Y437L | ++++ |
| 1599/1600 | Q274N; Q373T; Y437L | ++++ |
| 1601/1602 | N13K; Q373T | ++++ |
| 1603/1604 | N13K; I262V | ++++ |
| 1605/1606 | N13K; Y437L; L541R | ++++ |
| 1607/1608 | N13K; I262V; Q274N; L595W | ++++ |
| 1609/1610 | I262V; P380H | ++++ |
| 1611/1612 | I262V; Q274N | ++++ |
| 1613/1614 | N13K; G328R; Y437C | +++ |
| 1615/1616 | I262V; L541R | ++++ |
| 1617/1618 | I262V; Q373T; L595W | +++ |
| 1619/1620 | N13K; I262V; Y437L; N488L | +++ |
| 1621/1622 | N13K; Y437L | +++ |
| 1623/1624 | Q373T; L595W | ++++ |
| 1625/1626 | P380H; Y437C | ++++ |
| 1627/1628 | G641D | +++ |
| 1629/1630 | N13K; Q274N; Q373T; Y437C | ++++ |
| 1631/1632 | G45V; I262V; Q274N; Q373T; Y437C | ++++ |
| 1633/1634 | N13K; I262V; Q274N; P380H | ++++ |
| 1635/1636 | Q274N; V393P; Y437L | ++++ |
| 1637/1638 | Q274N; P380H | ++++ |
| 1639/1640 | I262V; Y437C | +++ |
| 1641/1642 | Q274N; Y437L; L541R | ++++ |
| 1643/1644 | G224W | ++++ |
| 1645/1646 | P263S; Q274N | ++++ |
| 1647/1648 | P263S; Q274N; P380L | ++++ |
| 1649/1650 | P263S; P380K | ++++ |
| 1651/1652 | Q274N; G328L | ++++ |
| 1653/1654 | A354T; P380K | ++++ |
| 1655/1656 | D217P; Q274N; V478M | ++++ |
| 1657/1658 | V478M; I561T | ++++ |
| 1659/1660 | D217P; P380L | ++++ |
| 1661/1662 | D37M; Y89R; Q274N | ++++ |
| 1663/1664 | Y89R; Q274N; P380R | ++++ |
| 1665/1666 | D37Y; P263S; Q274N; P380K; G559S; I561T | ++++ |
| 1667/1668 | D37V; P380K | +++ |
| 1669/1670 | Q274N; A354T | ++++ |
| 1671/1672 | D217P; Q274N; P380K; I561T | ++++ |
| 1673/1674 | D217P; A354T; P380K | ++++ |
| 1675/1676 | P380K; G559S; I561T | +++ |
| 1677/1678 | P263S; P380K; T441I | ++++ |
| 1679/1680 | Q274N; P380R; T441I | ++++ |
| 1681/1682 | D37M; Y89R | ++++ |
| 1683/1684 | Q274N; P380K | ++++ |
| 1685/1686 | D217P; P380R | ++++ |
| 1687/1688 | P263S; A354T; P380K; G559S | ++++ |
| 1689/1690 | Q274N; P380R; G559S | +++ |
| 1691/1692 | Y89R; P263S; G559S | +++ |
| 1693/1694 | Y89R; P263S; Q274N; P380R | ++++ |
| 1695/1696 | Y89R; P263S; Q274N; P380K | ++++ |
| 1697/1698 | P263S; Q274N; P380R | ++++ |

† Selectivity (% ee) was defined as follows: "+" 20.0 to 40.0, "++" 40.0 to 60.0, "+++" 60.0 to 80.0, "++++" 80.0 to 99.0

Example 19

GOA Improvements Over SEQ ID NO: 1598 for Enantioselective Production of Compound Y SEQ ID NO: 1598 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 40 μL clarified lysate from a 200 uL lysis total volume, 30 g/L Compound X, ~200 mM NaPi buffer, 200 μM $CuSO_4$, 0.2 g/L HRP, 0.20 g/L catalase, at pH 6.5. The plates were sealed with $O_2$-permeable seals and incubated at 30° C. and agitated at 300 rpm for 4 hours in a 50 mm throw Kuhner shaker maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of S-AMP and incubating with shaking in a 96-well half-deepwell plate for ~45 minutes at 30° C. The samples were quenched by adding 200 μL MeCN, shaking briefly to mix, and centrifuged at 4000 rpm at 4° C. for five minutes. The supernatant was transferred to a 96-well shallow-well plate and heat sealed for analysis by Analytical Method 21.1.

TABLE 19.1

Enzyme Variant Activity and Selectivity
Relative to SEQ ID NO: 1598

| SEQ ID NO: (nt/aa) | Amino Acid Differences (Relative to SEQ ID NO: 1598) | Selectivity (% ee R) † |
|---|---|---|
| 1699/1700 | N13K; P470L; G559S; I563A | +++ |
| 1701/1702 | I262V; P263S; G559S; I563A | ++++ |
| 1703/1704 | Q43F; V46A; I56Y; V63T; S99H; Q156L; I262V; P263S; S403P; G559S; I563A | ++++ |
| 1705/1706 | G559S; G641D | ++++ |
| 1707/1708 | S99H; L437V | ++++ |
| 1709/1710 | S99H; Q156L; I262V; P263S; P380K; L437C; G559S | ++++ |
| 1711/1712 | I262V; P263S | ++++ |
| 1713/1714 | I262V; L437V; G641D | ++++ |
| 1715/1716 | N13K; P380K; L437V; G559S | ++++ |
| 1717/1718 | S99H; P380K; L437C; G559S; G641D | ++++ |
| 1719/1720 | N13K; Q156L; P380K | ++++ |
| 1721/1722 | N13K; Q156L; L437C | ++++ |
| 1723/1724 | S99H; Q156L; P380K | ++++ |
| 1725/1726 | N13K; I262V; P263S | ++++ |
| 1727/1728 | N13K; S99H; P263S; P380K; L437V; G641D | ++++ |
| 1729/1730 | S99H; Q156L; P380K; L437V | ++++ |
| 1731/1732 | P263S; L437V; G559S; I563A | ++++ |
| 1733/1734 | N13K; S99H; Q156L; I262V; L437C; G559S; G641D | ++++ |
| 1735/1736 | S99H; P380K; I563A | ++++ |
| 1737/1738 | N13K; Q156L; I262V; P263S; L437C; G559S | ++++ |
| 1739/1740 | S99H; I262V; L437V; G559S | ++++ |
| 1741/1742 | N13K; L437V | ++++ |
| 1743/1744 | N13K; S99H; P380K; L437V | ++++ |
| 1745/1746 | S99H; I262V; P263S; L437V; G559S; G641D | ++++ |
| 1747/1748 | N13K; S99H; P380K; L437R; G559S | ++++ |
| 1749/1750 | N13K; S99H; S257R; I262V; P263S; G559S | ++++ |
| 1751/1752 | N13K; S99H; I262V; P263S; P380K; L437R; I563A; G641D | ++++ |
| 1753/1754 | S99H; Q156L; I262V; P263S; L437C | ++++ |
| 1755/1756 | S99H; Q156L; P263S; G559S | ++++ |
| 1757/1758 | N13K; S99H; I563A; G641D | ++++ |
| 1759/1760 | N13K; P380K; L437C | ++++ |
| 1761/1762 | N13K; I262V; P380K; L437V; G559S | ++++ |
| 1763/1764 | S99H; P263S; L437R; I563A | ++++ |
| 1765/1766 | N13K; L437R | ++++ |
| 1767/1768 | S99H | ++++ |
| 1769/1770 | S99H; Q156L; I262V | ++++ |
| 1771/1772 | S99H; Q156L; I262V; P263S; G559S | ++++ |
| 1773/1774 | N13K; S99H; Q156L; P380K; L437C | ++++ |
| 1775/1776 | N13K; S99H; P263S | ++++ |
| 1777/1778 | N13K; S99H; L437V; I563A | ++++ |
| 1779/1780 | N13K; I262V | ++++ |
| 1781/1782 | P263S; P380K | ++++ |
| 1783/1784 | N13K; S99H; P263S; P380K | ++++ |

TABLE 19.1-continued

Enzyme Variant Activity and Selectivity
Relative to SEQ ID NO: 1598

| SEQ ID NO: (nt/aa) | Amino Acid Differences (Relative to SEQ ID NO: 1598) | Selectivity (% ee R) † |
|---|---|---|
| 1785/1786 | S99H; Q156L; I262V; P263S; P380K; L437V; G559S | ++++ |
| 1787/1788 | S99H; Q156L; L437V | ++++ |
| 1789/1790 | I262V | ++++ |
| 1791/1792 | P380K | ++++ |
| 1793/1794 | K30E | ++++ |
| 1795/1796 | N13K; S99H; Q156L; P380K; L437V; G559S; I563A; G641D | ++++ |
| 1797/1798 | I262V; P263S; L437C; G559S | ++++ |
| 1799/1800 | T565S | ++++ |
| 1801/1802 | L615I | ++++ |
| 1803/1804 | Y254L | ++++ |
| 1805/1806 | A175G | ++++ |
| 1807/1808 | I287L | ++++ |
| 1809/1810 | I177L | ++++ |
| 1811/1812 | S409R | ++++ |
| 1813/1814 | P592K | ++++ |
| 1815/1816 | S409H | ++++ |
| 1817/1818 | W208F | ++++ |
| 1819/1820 | N601G | ++++ |
| 1821/1822 | A149R | ++++ |
| 1823/1824 | S280M | ++++ |
| 1825/1826 | N356S | ++++ |
| 1827/1828 | D610V | ++++ |
| 1829/1830 | T62D | ++++ |
| 1831/1832 | N29V | ++++ |
| 1833/1834 | W208L | ++++ |
| 1835/1836 | T251V | ++++ |
| 1837/1838 | T278L | ++++ |
| 1839/1840 | P489I | ++++ |
| 1841/1842 | I569L | ++++ |
| 1843/1844 | A149N | ++++ |
| 1845/1846 | V184L | ++++ |
| 1847/1848 | M234L | ++++ |
| 1849/1850 | T62G | ++++ |
| 1851/1852 | T62Q | ++++ |
| 1853/1854 | T596S | ++++ |
| 1855/1856 | P489L | ++++ |
| 1857/1858 | P592G | ++++ |
| 1859/1860 | S280N | ++++ |
| 1861/1862 | N601L | ++++ |
| 1863/1864 | Q373K | ++++ |
| 1865/1866 | E407Q | ++++ |
| 1867/1868 | Q373D | ++++ |
| 1869/1870 | E466V | ++++ |
| 1871/1872 | G197A | ++++ |
| 1873/1874 | A108F | ++++ |
| 1875/1876 | A194Q | ++++ |
| 1877/1878 | G197P | ++++ |
| 1879/1880 | I463V | ++++ |

† Selectivity (% ee) was defined as follows: "+" 20.0 to 40.0, "++" 40.0 to 60.0, "+++" 60.0 to 80.0, "++++" 80.0 to 99.0

Example 20

Spectrophotometric Analytical Detection of R-AMP-Derived 2-Ethynylglyceraldehyde Data described in Example 12 and 13 were collected using the analytical method provided in Table 20.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 20.1

| Analytical Method | |
|---|---|
| Instrument | Molecular Devices Spectramax M2 |
| Analysis Plate | Greiner Bio-one, "UV-Star" 96-well Plate, Microplate, COC, F-Bottom, Chimney Well. |
| Sample Volume | 200 µL |
| Detection | UV: 340 nm |
| Temperature | Room Temperature |

Example 21

Analytical Detection of Enantiomers of R-AMP-Derived 2-Ethynylglyceraldehyde

Data described in Example 19, 22, 28 and 30 were collected using the analytical method provided in Table 21.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 21.1

| Analytical Method | |
|---|---|
| Instrument | Agilent 1100 - HPLC |
| Column | ChiralPak IA column, 2.1 × 150 mm, 5 uM |
| Mobile Phase | A: heptane, 0.1% diethylamine (v/v); B: ethanol, 0.1% diethylamine (v/v) |
| Gradient | Isocratic at 7% B. |
| Flow Rate | 1.0 mL/min |
| Run Time | 3.0 min |
| Product Elution order | R-2-ethynylglyceraldehyde: ~1.7 min S-2-ethynylglyceraldehyde: ~2.2 min |
| Column Temperature | 40° C. |
| Injection Volume | 2 µL |
| Detection | UV 260 nm |

Example 22

GOA Improvements Over SEQ ID NO: 1866 for Enantioselective Production of Compound Y SEQ ID NO: 1866 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 40 µL clarified lysate from a 200 uL lysis total volume, 30 g/L Compound X, ~200 mM NaPi buffer, 200 µM $CuSO_4$, 0.2 g/L HRP, 0.20 g/L catalase, at pH 6.5. The plates were sealed with $O_2$-permeable seals and incubated at 30° C. and agitated at 300 rpm for 4 hours in a 50 mm throw Kuhner shaker maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of S-AMP and incubating with shaking in a 96-well half-deepwell plate for ~45 minutes at 30° C. The samples were quenched by adding 2004 MeCN, shaking briefly to mix, and centrifuged at 4000 rpm at 4° C. for five minutes. The supernatant was transferred to a 96-well shallow-well plate and heat sealed for analysis by Analytical Method 21.1.

TABLE 22.1

Enzyme Variant Activity and Selectivity Relative to SEQ ID NO: 1866

| SEQ ID NO: (nt/aa) | Amino Acid Differences (Relative to SEQ ID NO: 1866) | Selectivity (% ee) † |
|---|---|---|
| 1881/1882 | M234L | ++++ |
| 1883/1884 | Q373D; E466V | ++++ |
| 1885/1886 | T62Q; E466V | ++++ |
| 1887/1888 | E466V | ++++ |
| 1889/1890 | I569L | ++++ |
| 1891/1892 | G197A; E466V; I569L; T596S | ++++ |
| 1893/1894 | T62D; E466V; N597A | ++++ |
| 1895/1896 | T62D; E466V | ++++ |
| 1897/1898 | C384N; I569L | ++++ |
| 1899/1900 | T62Q; Q373D; E466V | ++++ |
| 1901/1902 | G197A | ++++ |
| 1903/1904 | I569L; N597A | ++++ |
| 1905/1906 | V184L | ++++ |
| 1907/1908 | T62Q; E466V; N597A | ++++ |
| 1909/1910 | M234L; C384N | ++++ |
| 1911/1912 | G197P; I463V; P592G | ++++ |
| 1913/1914 | I463V; T565S | ++++ |
| 1915/1916 | N29V; G197P; P592G | ++++ |
| 1917/1918 | I177L; S280N; I463V; T594M; N601L | ++++ |
| 1919/1920 | I177L; A194Q; G197P; I463V; T565S | ++++ |
| 1921/1922 | I177L; G197P; I463V; T565S | ++++ |
| 1923/1924 | I177L; I463V; T565S | ++++ |
| 1925/1926 | I177L; I463V; P592G | ++++ |
| 1927/1928 | A149N; I463V | ++++ |
| 1929/1930 | N29V; I177L; I463V | ++++ |
| 1931/1932 | N29V; I177L; G197P; P592G | ++++ |
| 1933/1934 | N29V; I463V | ++++ |
| 1935/1936 | G197P; S280N; I463V | ++++ |
| 1937/1938 | K546E | ++++ |
| 1939/1940 | T251V | ++++ |
| 1941/1942 | A149R | ++++ |
| 1943/1944 | T251V; T399V; L615I | ++++ |
| 1945/1946 | T62G; T286C; L615I | ++++ |
| 1947/1948 | T62G; W208F; I417L; L615I | ++++ |
| 1949/1950 | I417L; L615I | ++++ |
| 1951/1952 | A149R; W208F; L615I | ++++ |
| 1953/1954 | W208F; T251V; D259N; T278L | ++++ |
| 1955/1956 | T278L | ++++ |
| 1957/1958 | T399V; L615I | ++++ |
| 1959/1960 | T251V | ++++ |
| 1961/1962 | N29V; A149N; I463V; N601L | ++++ |

† Selectivity (% ee) was defined as follows: "+" 20.0 to 40.0, "++" 40.0 to 60.0, "+++" 60.0 to 80.0, "++++" 80.0 to 99.0.

Example 23

GOA Improvements Over SEQ ID NO: 1912 for Enantioselective Production of Compound Y SEQ ID NO: 1912 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 204 clarified lysate from a 200 uL lysis total volume, 30 g/L Compound X, ~200 mM NaPi buffer, 200 μM CuSO$_4$, 0.2 g/L HRP, 0.20 g/L catalase, at pH 6.5. The plates were sealed with O$_2$-permeable seals and incubated at 30° C. and agitated at 300 rpm for 4 hours in a 50 mm throw Kuhner shaker maintained at 85% RH.

The enzyme variants in the plate wells were diluted 10-fold with 0.04% TFA in acetonitrile by adding 20 uL of the reaction to a 96-deep-well plate containing 180 uL of 0.04% TFA in acetonitrile. The samples were centrifuged at 4000 rpm at 4° C. for five minutes. The supernatants were diluted 4-fold with deinonized (DI) water by adding 50 uL of the supernatant to a 96-shallow-well plates containing 150 uL of DI water. The plates were heat sealed for analysis by Analytical Method 24.1.

TABLE 23.1

Enzyme Variant Activity and Selectivity Relative to SEQ ID NO: 1912

| SEQ ID NO: (nt/aa) | Amino Acid Differences (Relative to SEQ ID NO: 1912) | Activity (% conversion) † |
|---|---|---|
| 1963/1964 | P50T | ++ |
| 1965/1966 | Q43G | ++ |
| 1967/1968 | Q43T | ++ |
| 1969/1970 | P197L | ++ |
| 1971/1972 | K486I | ++ |
| 1973/1974 | S3K | + |
| 1975/1976 | T42F | + |
| 1977/1978 | W40P | + |
| 1979/1980 | P50V | + |
| 1981/1982 | K30N | + |
| 1983/1984 | Q43D | + |
| 1985/1986 | A142H | + |
| 1987/1988 | K486P | + |
| 1989/1990 | T38M | + |
| 1991/1992 | A142C | + |
| 1993/1994 | Q156T | + |
| 1995/1996 | Y44H | + |
| 1997/1998 | P50I | + |
| 1999/2000 | Q156L | + |
| 2001/2002 | R161V | + |
| 2003/2004 | P50H | + |
| 2005/2006 | K486L | + |
| 2007/2008 | A9L | + |
| 2009/2010 | N26T | + |
| 2011/2012 | K486V | + |
| 2013/2014 | A142V | + |
| 2015/2016 | K486R | + |
| 2017/2018 | Q79P | + |
| 2019/2020 | T18S | + |
| 2021/2022 | A142S | + |
| 2023/2024 | N601L | + |
| 2025/2026 | R161Q | + |
| 2027/2028 | N29T | + |
| 2029/2030 | L159G | + |
| 2031/2032 | Q75N | + |
| 2033/2034 | G135D | + |
| 2035/2036 | N29M | + |
| 2037/2038 | P197D | + |
| 2039/2040 | K30L | + |
| 2041/2042 | N29V | + |
| 2043/2044 | L159S | + |
| 2045/2046 | P50D | + |
| 2047/2048 | Q136A | + |
| 2049/2050 | G48P | + |
| 2051/2052 | A142G | + |
| 2053/2054 | K486A | + |
| 2055/2056 | N29A | + |
| 2057/2058 | K30R | + |
| 2059/2060 | Q136G | + |
| 2061/2062 | Q43P | + |
| 2063/2064 | N29Y | + |
| 2065/2066 | N26H | + |
| 2067/2068 | N26C | + |
| 2069/2070 | A4K | + |
| 2071/2072 | L159K | + |

TABLE 23.1-continued

Enzyme Variant Activity and Selectivity
Relative to SEQ ID NO: 1912

| SEQ ID NO: (nt/aa) | Amino Acid Differences (Relative to SEQ ID NO: 1912) | Activity (% conversion) † |
|---|---|---|
| 2073/2074 | G48C | + |
| 2075/2076 | Q79S | + |
| 2077/2078 | Q79A | + |

† Levels of increased activity were determined relative to the reference polypeptide of SEQ ID NO: 1912 and defined as follows: "+" 1.2 to 1.8, "++" 1.8 to 2.5, "+++" >2.5

Example 24

Analytical Detection of Conversion of Compound X to Compound Y

Data described in Example 23, 25, 26, 27 and 31 were collected using the analytical method provided in Table 24.1. The method provided herein finds use in analyzing the variants produced using the present invention. However, it is not intended that present invention be limited to the methods described herein, as there are other suitable methods known in the art that are applicable to the analysis of the variants provided herein and/or produced using the methods provided herein.

TABLE 24.1

Analytical Method

| | |
|---|---|
| Instrument | Thermo Scientific Dionex Ultimate 3000 |
| Column | Benson BP-800 Ca |
| Mobile Phase | A: DI water |
| Gradient | Isocratic at 100% A. |
| Flow Rate | 1.0 mL/min |
| Run Time | 2.5 min |
| Product Elution order | 2-ethynylglyceraldehyde: ~1.9 min |
| | 2-ethynylglycerol: ~2.1 min |
| Column Temperature | 80° C. |
| Injection Volume | 10 µL |
| Detection | UV 190 nm |

Example 25

GOA Improvements Over SEQ ID NO: 1912 for Enantioselective Production of Compound Y SEQ ID NO: 1912 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 60 µL clarified lysate from a 200 uL lysis total volume, 30 g/L Compound X, ~200 mM NaPi buffer, 200 µM CuSO$_4$, 0.2 g/L HRP, 0.20 g/L catalase, at pH 6.5. The plates were sealed with O$_2$-permeable seals and incubated at 30° C. and agitated at 300 rpm for 22 hours in a 50 mm throw Kuhner shaker maintained at 85% RH.

The enzyme variants in the plate wells were diluted 10-fold with 0.04% TFA in acetonitrile by adding 20 uL of the reaction to a 96-deep-well plate containing 180 uL of 0.04% TFA in acetonitrile. The samples were centrifuged at 4000 rpm at 4° C. for five minutes. The supernatants were diluted 4-fold with DI water by adding 50 uL of the supernatant to a 96-shallow-well plates containing 150 uL of DI water. The plates were heat sealed for analysis by Analytical Method 24.1.

TABLE 25.1

Enzyme Variant Activity and Selectivity
Relative to SEQ ID NO: 1912

| SEQ ID NO: (nt/aa) | Amino Acid Differences (Relative to SEQ ID NO: 1912) | Activity (% conversion) † |
|---|---|---|
| 2037/2038 | P197D | ++ |
| 2075/2076 | Q79S | + |
| 2079/2080 | F291Y; N375D; T453V; T465L | +++ |
| 2081/2082 | M279L; F291Y; T465L | +++ |
| 2083/2084 | M279L; F291Y; N375D; T465L; D536N; N538D | +++ |
| 2085/2086 | F291Y; T465L | +++ |
| 2087/2088 | F291Y; T429V; T465L | +++ |
| 2089/2090 | F291Y; T465L; N538D | ++ |
| 2091/2092 | F291Y; T453V; T465L; D536N; N538D | ++ |
| 2093/2094 | F291Y; L420I; T465L; Q481T; N538D | ++ |
| 2095/2096 | M279L; N375D; L420I; T429V; T453V; T465L; F472L; N538D | ++ |
| 2097/2098 | T453V; T465L | ++ |
| 2099/2100 | F291Y; N375D; L436M; T465G; N538D | ++ |
| 2101/2102 | N375D; T465G | ++ |
| 2103/2104 | N29S; P197D; Q407D; K486S | ++ |
| 2105/2106 | N29I; K30N; Q79S; P197D; Q407D | ++ |
| 2107/2108 | Q136G; P197D; Q407D | ++ |
| 2109/2110 | Q79S; Q136G; P197D; Q407D | ++ |
| 2111/2112 | N29S; K30N; P50V; Q79S; P197D; Q407D | ++ |
| 2113/2114 | N65A | ++ |
| 2115/2116 | N29A; K30R; P50V; Q79S; Q136G; P197D | + |
| 2117/2118 | N375D; L420I; T465L | + |
| 2119/2120 | Q79S; Q156C; P197D; Q407D | + |
| 2121/2122 | N29I; K30N; Q79S; P197D | + |
| 2123/2124 | N29S; K30R; Q136G; P197D; Q407D; K486S | + |
| 2125/2126 | N29I; K30R; P197D; Q407D | + |
| 2127/2128 | M279L; T465L | + |
| 2129/2130 | M279L; F291Y; T465L; D536N | + |
| 2131/2132 | T465G | + |
| 2133/2134 | L420I; L436M; T465L | + |
| 2135/2136 | N29S; K30R; Q79S; P197D; Q407D | + |
| 2137/2138 | T453V; T465G; V478F; Q481T | + |
| 2139/2140 | P197D; Q407D | + |
| 2141/2142 | N29S; P50V; P197D; Q407D; K486S | + |
| 2143/2144 | N375D; L420I; T465G | + |
| 2145/2146 | N29S; P197D; Q407D | + |
| 2147/2148 | N29S; K30R; P197D | + |
| 2149/2150 | K30N; P50T; Q79S; Q136G; Q156C; P197D | + |
| 2151/2152 | N29A; K30N; Q79E; Q136G; Q156C; P197D | + |
| 2153/2154 | T453V; T465G | + |
| 2155/2156 | F291Y; N375D; L420I; V430I; T465G; N538D | + |
| 2157/2158 | N375D; T465L | + |
| 2159/2160 | M279L; F291Y; N375D; L420I; T429V; L436M; T453V; T465G | + |
| 2161/2162 | N29I | + |
| 2163/2164 | Q136G | + |
| 2165/2166 | K30R | + |
| 2167/2168 | P50V; Q136G; P197D; K486I | + |
| 2169/2170 | N29T | + |
| 2171/2172 | N29A | + |
| 2173/2174 | Q43D; P197D; Q407D | + |
| 2175/2176 | N375D; T429V; T453V; T465G | + |
| 2177/2178 | N29S; K30R; Q136G; Q407D | + |
| 2179/2180 | N29S | + |
| 2181/2182 | M279L; T465G | + |
| 2183/2184 | K486S | + |

TABLE 25.1-continued

Enzyme Variant Activity and Selectivity
Relative to SEQ ID NO: 1912

| SEQ ID NO: (nt/aa) | Amino Acid Differences (Relative to SEQ ID NO: 1912) | Activity (% conversion) † |
|---|---|---|
| 2185/2186 | P197D; K486S | + |
| 2187/2188 | M279L; N375D; L420I; T465G | + |
| 2189/2190 | T429V; T465G | + |
| 2191/2192 | T465G; D536N; N538D | + |
| 2193/2194 | Q136G | + |
| 2195/2196 | N29S; K30R; Q79S; P197D | + |
| 2197/2198 | Q136G; P197D; K486I | + |
| 2199/2200 | L615I | + |
| 2201/2202 | Q156M; R161A; K486A | + |

† Activity (% conversion) was defined as follows: "+" 60.0 to 70.0, "++" 70.0 to 80.0, "+++" 80.0 to 90.0, "++++" 90.0 to 99.0

Example 26

GOA Improvements Over SEQ ID NO: 2080 for Enantioselective Production of Compound Y SEQ ID NO: 2080 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 30 μL clarified lysate from a 200 uL lysis total volume, 30 g/L Compound X, ~200 mM NaPi buffer, 200 μM CuSO$_4$, 0.2 g/L HRP, 0.20 g/L catalase, at pH 6.5. The plates were sealed with O$_2$-permeable seals and incubated at 30° C. and agitated at 300 rpm for 2 hours in a 50 mm throw Kuhner shaker maintained at 85% RH.

The enzyme variants in the plate wells were diluted 10-fold with 0.04% TFA in acetonitrile by adding 20 uL of the reaction to a 96-deep-well plate containing 180 uL of 0.04% TFA in acetonitrile. The samples were centrifuged at 4000 rpm at 4° C. for five minutes. The supernatants were diluted 4-fold with DI water by adding 50 uL of the supernatant to a 96-shallow-well plates containing 150 uL of DI water. The plates were heat sealed for analysis by Analytical Method 24.1.

TABLE 26.1

Enzyme Variant Activity and Selectivity
Relative to SEQ ID NO: 2080

| SEQ ID NO: (nt/aa) | Amino Acid Differences (Relative to SEQ ID NO: 2080) | Activity (% conversion) † |
|---|---|---|
| 2203/2204 | N47L | ++ |
| 2205/2206 | A324G | ++ |
| 2207/2208 | L437R | ++ |
| 2209/2210 | I214L | ++ |
| 2211/2212 | D408A | ++ |
| 2213/2214 | S626W | ++ |
| 2215/2216 | T119Q | ++ |
| 2217/2218 | E480L | ++ |
| 2219/2220 | N414L | ++ |
| 2221/2222 | N598T | ++ |
| 2223/2224 | P121G | ++ |
| 2225/2226 | P197G | + |
| 2227/2228 | P197M | + |
| 2229/2230 | P197L | + |
| 2231/2232 | P197R | + |
| 2233/2234 | P197E | + |
| 2235/2236 | G600D | + |
| 2237/2238 | P197S | + |
| 2239/2240 | N78L | + |
| 2241/2242 | V556S | + |
| 2243/2244 | D365H | + |
| 2245/2246 | P197H | + |
| 2247/2248 | S220Q | + |
| 2249/2250 | Y485L | + |
| 2251/2252 | S24R | + |
| 2253/2254 | P197Q | + |
| 2255/2256 | V95R | + |
| 2257/2258 | S207Q | + |
| 2259/2260 | E520L | + |
| 2261/2262 | N47D | + |
| 2263/2264 | P197W | + |
| 2265/2266 | A571S | + |
| 2267/2268 | T219V | + |
| 2269/2270 | K249N | + |
| 2271/2272 | V63T | + |
| 2273/2274 | S220R | + |
| 2275/2276 | G294K | + |
| 2277/2278 | L437N | + |

† Levels of increased activity were determined relative to the reference polypeptide of SEQ ID NO: 2080 and defined as follows: "+" 1.2 to 1.8, "++" 1.8 to 2.5, "+++" >2.5

Example 27

GOA Improvements Over SEQ ID NO: 2080 for Enantioselective Production of Compound Y SEQ ID NO: 2080 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 60 μL clarified lysate from a 200 uL lysis total volume, 30 g/L Compound X, ~200 mM NaPi buffer, 200 μM CuSO$_4$, 0.2 g/L HRP, 0.20 g/L catalase, at pH 6.5. The plates were sealed with 02-permeable seals and incubated at 30° C. and agitated at 300 rpm for 22 hours in a 50 mm throw Kuhner shaker maintained at 85% RH.

The enzyme variants in the plate wells were diluted 10-fold with 0.04% TFA in Acetonitrile by adding 20 uL of the reaction to a 96-deep-well plate containing 180 uL of 0.04% TFA in Acetonitrile. The samples were centrifuged at 4000 rpm at 4° C. for five minutes. The supernatants were diluted 4-fold with DI water by adding 50 uL of the supernatant to a 96-shallow-well plates containing 150 uL of DI water. The plates were heat sealed for analysis by Analytical Method 24.1.

TABLE 27.1

Enzyme Variant Activity and Selectivity
Relative to SEQ ID NO: 2080

| SEQ ID NO: (nt/aa) | Amino Acid Differences (Relative to SEQ ID NO: 2080) | Activity (% conversion) † |
|---|---|---|
| 2225/2226 | P197G | ++++ |
| 2233/2234 | P197E | ++++ |
| 2237/2238 | P197S | ++++ |

TABLE 27.1-continued

Enzyme Variant Activity and Selectivity
Relative to SEQ ID NO: 2080

| SEQ ID NO: (nt/aa) | Amino Acid Differences (Relative to SEQ ID NO: 2080) | Activity (% conversion) † |
|---|---|---|
| 2241/2242 | V556S | +++ |
| 2253/2254 | P197Q | ++++ |
| 2255/2256 | V95R | +++ |
| 2267/2268 | T219V | +++ |
| 2271/2272 | V63T | +++ |
| 2279/2280 | P197R | ++++ |
| 2281/2282 | P197H | ++++ |
| 2283/2284 | N29I; P197D; K342R; L436M | ++++ |
| 2285/2286 | Q136G; P197D; L436M; V453T | ++++ |
| 2287/2288 | N29I; P197D; V453T | ++++ |
| 2289/2290 | P197D | ++++ |
| 2291/2292 | N29S; P197D | ++++ |
| 2293/2294 | N29S; Q136G; P197D; L436M | ++++ |
| 2295/2296 | N29I; P197D; L436M; V453T | ++++ |
| 2297/2298 | P197D; L436M; F472L | ++++ |
| 2299/2300 | N29I; P197D | ++++ |
| 2301/2302 | P197D; L436M; V453T | ++++ |
| 2303/2304 | N29I; P197D; L436M | ++++ |
| 2305/2306 | N29S; P197D; L436M | ++++ |
| 2307/2308 | P197D; V453T | ++++ |
| 2309/2310 | N29I; Q136G; P197D; L436M | ++++ |
| 2311/2312 | P197D; L436M | ++++ |
| 2313/2314 | Q136G; P197D; L436M | ++++ |
| 2315/2316 | Y359L | ++++ |
| 2317/2318 | N29S; P197D; L436M; V453T | ++++ |
| 2319/2320 | P197L | ++++ |
| 2321/2322 | N29I; L436M | ++++ |
| 2323/2324 | I144V | ++++ |
| 2325/2326 | L436M | ++++ |
| 2327/2328 | N29S; Q136G; L436M; V453T | ++++ |
| 2329/2330 | P197M | ++++ |
| 2331/2332 | N29S; V453T | ++++ |
| 2333/2334 | N29I | ++++ |
| 2335/2336 | Q43G | ++++ |
| 2337/2338 | E520Y | ++++ |
| 2339/2340 | N14T; I130M; S257Q; F472L | ++++ |
| 2341/2342 | Y485R | ++++ |
| 2343/2344 | K249N | ++++ |
| 2345/2346 | N14T; S257Q | +++ |
| 2347/2348 | A495T | +++ |
| 2349/2350 | N29S; L436M | +++ |
| 2351/2352 | S257A | +++ |
| 2353/2354 | P197W | +++ |
| 2355/2356 | N29S; L436M; F472L | +++ |
| 2357/2358 | G592H | +++ |
| 2359/2360 | N29I; Q136G | +++ |
| 2361/2362 | L437R | +++ |
| 2363/2364 | N29S; F472L | +++ |
| 2365/2366 | T119M | +++ |
| 2367/2368 | S24Q | +++ |
| 2369/2370 | L437G | +++ |
| 2371/2372 | I214A | +++ |
| 2373/2374 | L437Y | +++ |
| 2375/2376 | V63E | +++ |
| 2377/2378 | M567S | +++ |
| 2379/2380 | N29I; Q136G; L436M | +++ |
| 2381/2382 | Q136G; L436M | +++ |
| 2383/2384 | E297T | +++ |
| 2385/2386 | W560I | +++ |
| 2387/2388 | W560G | +++ |
| 2389/2390 | N14K; S257E | +++ |
| 2391/2392 | Q460G | +++ |
| 2393/2394 | Q136G | +++ |
| 2395/2396 | I130V; G421N | +++ |
| 2397/2398 | S257A; F472L | +++ |

† Activity (% conversion) was defined as follows: "+" 60.0 to 70.0, "++" 70.0 to 80.0, "+++" 80.0 to 90.0, "++++" 90.0 to 99.0

Example 28

GOA Improvements Over SEQ ID NO: 2300 for Enantioselective Production of Compound Y SEQ ID NO: 2300 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 μL reaction was carried out in 96-well deep-well plates with 60 μL clarified lysate from a 200 uL lysis total volume, 30 g/L Compound X, ~200 mM NaPi buffer, 200 μM CuSO$_4$, 0.2 g/L HRP, 0.20 g/L catalase, at pH 6.5. The plates were sealed with O2-permeable seals and incubated at 30° C. and agitated at 300 rpm for 22 hours in a 50 mm throw Kuhner shaker maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of S-AMP and incubating with shaking in a 96-well half-deepwell plate for ~45 minutes at 30° C. The samples were quenched by adding 200λ MeCN, shaking briefly to mix, and centrifuged at 4000 rpm at 4° C. for five minutes. The supernatant was transferred to a 96-well shallow-well plate and heat sealed for analysis by Analytical Method 21.1.

TABLE 28.1

Enzyme Variant Activity and Selectivity
Relative to SEQ ID NO: 2300

| SEQ ID NO: (nt/aa) | Amino Acid Differences (Relative to SEQ ID NO: 2300) | Selectivity (% ee) † |
|---|---|---|
| 2399/2400 | D197L; S207D | ++++ |
| 2401/2402 | T119M; D197M; F339V | ++++ |
| 2403/2404 | T219V | ++++ |
| 2405/2406 | V63T; T119M; V556G | ++++ |
| 2407/2408 | D197S; T219I | ++++ |
| 2409/2410 | T119M; D197M; V556G | ++++ |
| 2411/2412 | V63T; D197M; V556G; A571S | ++++ |
| 2413/2414 | I214A; K249N; Y359L | ++++ |
| 2415/2416 | T119M; D197M | ++++ |
| 2417/2418 | V63T; N67K; I214A; V556G | ++++ |
| 2419/2420 | T119M; D197S; V556G | ++++ |
| 2421/2422 | V63T; D197R; K249N; A495T | ++++ |
| 2423/2424 | D197R; T219V | ++++ |
| 2425/2426 | D197M | ++++ |
| 2427/2428 | D197H; I214A | ++++ |
| 2429/2430 | V63T; D197G | ++++ |
| 2431/2432 | T119M; D197S | ++++ |
| 2433/2434 | D197L; V556G | ++++ |
| 2435/2436 | S24Q; T119M; D197R | ++++ |
| 2437/2438 | V63T | ++++ |
| 2439/2440 | V63T; T119M; D197S | ++++ |
| 2441/2442 | D197M; V556G; A571S | ++++ |
| 2443/2444 | V63T; D197S; I214A; A571S | ++++ |
| 2445/2446 | D197S; I214A | ++++ |
| 2447/2448 | T119M; D197L; A571S | ++++ |
| 2449/2450 | T119M; D197G; I214A; V556G | ++++ |
| 2451/2452 | D197M; I214A | ++++ |
| 2453/2454 | Q43G; K249N | ++++ |
| 2455/2456 | V63T; T119M; D197L; F339V; W341R | ++++ |
| 2457/2458 | D197S | ++++ |
| 2459/2460 | D197L | ++++ |
| 2461/2462 | V95R; D197R | ++++ |
| 2463/2464 | V63T; D197S | ++++ |
| 2465/2466 | T119M; D197M; I214A; A571S | ++++ |

TABLE 28.1-continued

Enzyme Variant Activity and Selectivity
Relative to SEQ ID NO: 2300

| SEQ ID NO: (nt/aa) | Amino Acid Differences (Relative to SEQ ID NO: 2300) | Selectivity (% ee) † |
|---|---|---|
| 2467/2468 | D197S; V556G | ++++ |
| 2469/2470 | T119M; D197S; I214A | ++++ |
| 2471/2472 | V63T; N67K; D197S; A571S | ++++ |
| 2473/2474 | V63T; T119M; D197L; S207D; I214A | ++++ |
| 2475/2476 | S24Q | ++++ |
| 2477/2478 | S24Q; D197Q; K249N; L437R | ++++ |
| 2479/2480 | T119M; D197S; A571S | ++++ |
| 2481/2482 | V63T; T119M; D197S; V556G; A571S | ++++ |
| 2483/2484 | T119M | ++++ |
| 2485/2486 | V95R; T219V; Y359L | ++++ |
| 2487/2488 | V63T; T119M; D197G; V556G | ++++ |
| 2489/2490 | V556G | ++++ |
| 2491/2492 | V63T; D197S; S207D; V556G | ++++ |
| 2493/2494 | Q43G; D197R; Y359L | ++++ |
| 2495/2496 | T119M; S207D; V556G; A571S | ++++ |
| 2497/2498 | D197S; V556G; A571S | ++++ |
| 2499/2500 | D197M; F339V; V556G; A571S | ++++ |
| 2501/2502 | T119M; D197S; V556G; A571S | ++++ |
| 2503/2504 | D197S; A571S | ++++ |
| 2505/2506 | V63T; D197S; S207D; V556G; A571S | ++++ |
| 2507/2508 | T119M; D197G; S207D; A571S | ++++ |
| 2509/2510 | D197G; S207D; I214A; V471I | ++++ |
| 2511/2512 | S24Q; K51Q; V63T; D197R; Y359L | ++++ |
| 2513/2514 | T119M; D197L; I214A; V556G | ++++ |

† Selectivity (% ee) was defined as follows: "+" 20.0 to 40.0, "++" 40.0 to 60.0, "+++" 60.0 to 80.0, "++++" 80.0 to 99.0

Example 29

GOA Improvements Over SEQ ID NO: 2300 for Improved Production of Compound P

Directed evolution efforts were performed which focused on evolving a GOase variant with improved activity on the ethynyl glycerol phosphate (EGP) for generating the corresponding phosphorylated aldehyde (Compound P) (See, Scheme 3, above).

SEQ ID NO: 2300 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 20 µL of 2-fold diluted clarified lysate from a 200 uL lysis total volume, 10 g/L of ethynyl glycerol phosphate, 200 µM $CuSO_4$, 1 g/L HRP, 0.20 g/L catalase, 50 mM PIPES buffer, at pH 7.0. The plates were heat-sealed and shaken at 400 rpm for 3 hours at 30° C.

After 3 hours, the samples were diluted with 200 µL of 50 mM potassium phosphate, pH 7.5. In separate plates, 50 µL of the diluted samples were transferred and mixed with 150 µL of 10 g/L solution O-benzylhydrozylamine in methanol. The plates were sealed and shaken at 400 rpm, at 25° C. for 20-30 minutes. Derivatized samples were diluted 2× in methanol prior to UPLC analysis, as described in the Table 29.1.

TABLE 29.1

Analytical Method

| Instrument | Thermo Fisher UltiMate 3000 |
|---|---|
| Column | Waters Acquity HSS T3, 2.1 × 50 mm |
| Mobile Phase | Gradient (A: 0.1% formic acid in water; B: 0.1% formic acid in acetonitrile |

| Time(min) | % B |
|---|---|
| 0.00 | 8 |
| 0.10 | 8 |
| 1.00 | 70 |
| 1.10 | 100 |
| 1.50 | 8 |
| 2.1 | 8 |

| Flow Rate | 1.0 mL/min |
|---|---|
| Run time | 2.1 min |
| Peak Retention Time | derivatized product at 1.28 min |
| Column Temperature | 40° C. |
| Injection Volume | 5 µL |
| UV Detection | 254 nm |

TABLE 29.2

Enzyme Variant Activity and Selectivity
Relative to SEQ ID NO: 2300

| SEQ ID NO: (nt/aa) | Amino Acid Differences (Relative to SEQ ID NO: 2300) | Activity (FIOP Product) † |
|---|---|---|
| 2515/2516 | E196R | +++ |
| 2517/2518 | Q327R | +++ |
| 2519/2520 | Q407R | +++ |
| 2521/2522 | L465R | ++ |
| 2523/2524 | Y330H | ++ |
| 2525/2526 | F442Y | ++ |
| 2527/2528 | N246Q; F442Y | + |
| 2529/2530 | T583S | + |
| 2531/2532 | Q327K | + |
| 2533/2534 | N246Q; D408N; F442Y; G462A | + |
| 2535/2536 | S292R | + |
| 2537/2538 | T583G | + |
| 2539/2540 | G462A; T583A | + |
| 2541/2542 | Q407K | + |
| 2543/2544 | S498C | + |
| 2545/2546 | E196Q | + |
| 2547/2548 | Q327R; L329W | + |
| 2549/2550 | N246S; F442Y | + |
| 2551/2552 | F442Y; G462A; L515M | + |
| 2553/2554 | A194G; Y330H; A495S | + |

† Levels of increased activity were determined relative to the reference polypeptide of SEQ ID NO: 2300 and defined as follows: "+" 1.50 to 2.50, "++" >2.50 "+++" >5.00

Example 30

GOA Improvements Over SEQ ID NO: 2424 for Enantioselective Production of Compound Y SEQ ID NO: 2424 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 60 µL clarified lysate from a 200 uL lysis total volume, 30 g/L Compound X, 50 mM PIPES buffer, 200 µM $CuSO_4$, 0.2 g/L HRP, 0.20 g/L catalase, at pH 6.5. The plates were sealed with $O_2$-permeable seals and incubated at 30° C. and agitated at 300 rpm for 22 hours in a 50 mm throw Kuhner shaker maintained at 85% RH.

The enzyme variants in the plate wells were diluted 2-fold with acetonitrile by adding 35 uL of the reaction to a 96-well shallow-well plate containing 35 uL of acetonitrile. 20 uL of this 2-fold diluted reaction was derivatized by adding 10 uL of 100 g/L solution in acetonitrile of S-AMP and incubating with shaking in a 96-well half-deepwell plate for ~45 minutes at 30° C. The samples were quenched by adding 200 µL of MeCN:heptane (1:1) mixture, shaking briefly to mix, and centrifuged at 4000 rpm at 4° C. for five minutes. The supernatant was transferred to a 96-well shallow-well plate and heat sealed for analysis by Analytical Method 21.1.

TABLE 30.1

Enzyme Variant Activity and Selectivity Relative to SEQ ID NO: 2424

| SEQ ID NO: (nt/aa) | Amino Acid Differences (Relative to SEQ ID NO: 2424) | Selectivity (% ee) † |
|---|---|---|
| 2555/2556 | D408Q | ++++ |
| 2557/2558 | E480L | ++++ |
| 2559/2560 | G600N | ++++ |
| 2561/2562 | K36L | ++++ |
| 2563/2564 | N14L | ++++ |
| 2565/2566 | N14R | ++++ |
| 2567/2568 | N532G | ++++ |
| 2569/2570 | N96M | ++++ |
| 2571/2572 | N96S | ++++ |
| 2573/2574 | P404A | ++++ |
| 2575/2576 | R120S | ++++ |
| 2577/2578 | R218M | ++++ |
| 2579/2580 | R549L | ++++ |
| 2581/2582 | S24P | ++++ |
| 2583/2584 | S537C | ++++ |
| 2585/2586 | S92C | ++++ |
| 2587/2588 | S92G | ++++ |
| 2589/2590 | S92V | ++++ |
| 2591/2592 | S99L | ++++ |
| 2593/2594 | S99V | ++++ |
| 2595/2596 | V46P | ++++ |
| 2597/2598 | V95A | ++++ |
| 2599/2600 | W560I | ++++ |
| 2601/2602 | Y485C | ++++ |
| 2603/2604 | S24P; V46E; S92G; S426W; R549L | ++++ |
| 2605/2606 | K36L; S426W; Y485C; G600N | ++++ |
| 2607/2608 | S24P; V46E; S92G; P404A; S426W; N532G | ++++ |
| 2609/2610 | S99V; P404A; S426W; W560E | ++++ |
| 2611/2612 | S24P; V46E; S92G; S426W; N532G | ++++ |
| 2613/2614 | S24P; K36L; P404A; E480L; Y485C; N532G; W560E; G600N | ++++ |
| 2615/2616 | S24P; S99V | ++++ |
| 2617/2618 | S24P; V46E; P404A; S426W; Y485C; N532G | ++++ |
| 2619/2620 | S24P; K36L; S99V; P404A; S426W; N532G; R549L; G600N | ++++ |
| 2621/2622 | S24P; V46E; S99V; S426W; R549L; G600N | ++++ |
| 2623/2624 | S92G; V95S; Y485C; N532G; R549L; W560E | ++++ |
| 2625/2626 | S24P; K36L; V46E; S99V; S426W; N532G; R549L | ++++ |
| 2627/2628 | S99V; S426W; E480L; Y485C | ++++ |
| 2629/2630 | K36L; S92G; Y485C | ++++ |
| 2631/2632 | S24P; S99V; P404A; Y485C; N532G; G600N | ++++ |
| 2633/2634 | S24P; K36L; P404A; S426W; N532G | ++++ |
| 2635/2636 | K36L; P404A | ++++ |
| 2637/2638 | S24P; V46E; V95S; S99V; S426W; N532G | ++++ |
| 2639/2640 | S24P; P404A; E480L; N532G; R549L; W560E | ++++ |
| 2641/2642 | S24P; N96M; P404A; S426W | ++++ |
| 2643/2644 | K36L; S92G; V95S; S99V; P404A; S426W; W560E | ++++ |
| 2645/2646 | S24P; P404A; E480L; Y485C | ++++ |
| 2647/2648 | S24P; K36L; N96M; S99V; N532G; R549L | ++++ |
| 2649/2650 | R549L; W560E | ++++ |
| 2651/2652 | S24P; K36L; V95S; S99V; P404A; S426W; Y485C | ++++ |
| 2653/2654 | K36L; P404A; S426W; R549L; G600N | ++++ |
| 2655/2656 | V95S; P404A; N532G | ++++ |
| 2657/2658 | P404A; Y485C; G600N | ++++ |
| 2659/2660 | S24P; P404A; S426W; N532G | ++++ |
| 2661/2662 | S92V; S99L; R218M; W560I | ++++ |

TABLE 30.1-continued

Enzyme Variant Activity and Selectivity Relative to SEQ ID NO: 2424

| SEQ ID NO: (nt/aa) | Amino Acid Differences (Relative to SEQ ID NO: 2424) | Selectivity (% ee) † |
|---|---|---|
| 2663/2664 | V46P; S92V; W560I | ++++ |
| 2665/2666 | N14L; S92V; N96S; R120S; R376M | ++++ |
| 2667/2668 | N14R; D408Q | ++++ |
| 2669/2670 | N14R; R376M; W560I | ++++ |
| 2671/2672 | N96S; S99L | ++++ |
| 2673/2674 | N14L; S92V; N96S; S99L | ++++ |
| 2675/2676 | N14R; S92V; S99L; R120S; S537C | ++++ |
| 2677/2678 | N14R; S24P; S92C; N96S; S99L; D408R | ++++ |
| 2679/2680 | V95R; R120L; V296R; S626G | ++++ |
| 2681/2682 | N14L; S92V; N96S; S99L; R120S; S537C | ++++ |
| 2683/2684 | N14A; S24V; N78I; R120L; S258V | ++++ |
| 2685/2686 | N14A; S24V; K36P; N96G | ++++ |
| 2687/2688 | S24V; V296R | ++++ |
| 2689/2690 | N14A; S24V; N96G; S258V; S626G | ++++ |
| 2691/2692 | R120L; A324F; E480R; W560M | ++++ |
| 2693/2694 | N14A; N78I; R120L; S258V; N488T; W560M; S626G | ++++ |
| 2695/2696 | S24V; K36P; V95R; N96G | ++++ |
| 2697/2698 | S24V; K36P; R120L; V296R; E480R; W560M | ++++ |
| 2699/2700 | K36P; S258V; V296R | ++++ |
| 2701/2702 | N96G | ++++ |
| 2703/2704 | N96L; S258V; W560M; S626G | ++++ |
| 2705/2706 | N14A; S24V; S258V; W560M | ++++ |
| 2707/2708 | S24V; V296R; A324F; E480R | ++++ |
| 2709/2710 | V296R; A324F | ++++ |
| 2711/2712 | V296R; A324F; W560M | ++++ |
| 2713/2714 | A324F; W560M | ++++ |
| 2715/2716 | N14A; S258V; V296R; W560M | ++++ |
| 2717/2718 | N14A; R120L; E480R; S626G | ++++ |
| 2719/2720 | E480R | ++++ |
| 2721/2722 | N14A; S24V; K36P; V296R; G424W; W560M | ++++ |
| 2723/2724 | K36P; S258V; V296R; A324F; S433G; S626G | ++++ |
| 2725/2726 | N14A; V95R; R120L; V296R; E480R; W560M | ++++ |
| 2727/2728 | N14A; S258V | ++++ |
| 2729/2730 | K36L; D408L; S537W; T596Q | ++++ |
| 2731/2732 | Q23A; K36L; S92C; V95F; N96G | ++++ |
| 2733/2734 | Q23A; K36L; S537W; T596Q | ++++ |
| 2735/2736 | K36L; S92C; V95F; N428H; T596Q | ++++ |
| 2737/2738 | S537W; Q640R | ++++ |
| 2739/2740 | K36L; D408L; T596Q | ++++ |
| 2741/2742 | R218G; D408L | ++++ |
| 2743/2744 | Q23A; R218G; S537W | ++++ |
| 2745/2746 | T596V | ++++ |
| 2747/2748 | K36L; S92C; N96G; D408L; N428H; N540R; T596V | ++++ |
| 2749/2750 | Q23A; D408L; T596V | ++++ |
| 2751/2752 | Q23A; K36L; D408L; N428H | ++++ |
| 2753/2754 | Q23A; K36L; S92C; V95F; S99F; D408L; T596V | ++++ |
| 2755/2756 | V95F | ++++ |
| 2757/2758 | D408L | ++++ |

† Selectivity (% ee) was defined as follows: "+" 20.0 to 40.0, "++" 40.0 to 60.0, "+++" 60.0 to 80.0, "++++" 80.0 to 99.0

Example 31

GOA Improvements Over SEQ ID NO: 2424 for Enantioselective Production of Compound Y SEQ ID NO: 2424 was selected as the parent enzyme for this round of directed evolution. Libraries of engineered genes were produced using well-established techniques (e.g., saturation mutagenesis, and recombination of previously identified beneficial mutations). The polypeptides encoded by each gene were produced in HTP as described in Example 2, and the clarified lysates were generated as described in Example 4.

Each 100 µL reaction was carried out in 96-well deep-well plates with 60 µL clarified lysate from a 200 uL lysis total volume, 30 g/L Compound X, 50 mM PIPES buffer, 200 µM CuSO$_4$, 0.2 g/L HRP, 0.20 g/L catalase, at pH 6.5. The plates were sealed with O$_2$-permeable seals and incubated at 30° C. and agitated at 300 rpm for 22 hours in a 50 mm throw Kuhner shaker maintained at 85% RH.

The enzyme variants in the plate wells were diluted 10-fold with 0.04% TFA in acetonitrile by adding 20 uL of the reaction to a 96-deep-well plate containing 180 uL of 0.04% TFA in acetonitrile. The samples were centrifuged at 4000 rpm at 4° C. for five minutes. The supernatants were diluted 4-fold with DI water by adding 50 uL of the supernatant to a 96-shallow-well plates containing 150 uL of DI water. The plates were heat sealed for analysis by Analytical Method 24.1.

TABLE 31.1

Enzyme Variant Activity and Selectivity Relative to SEQ ID NO: 2424

| SEQ ID NO: (nt/aa) | Amino Acid Differences (Relative to SEQ ID NO: 2424) | Activity (% conversion) † |
|---|---|---|
| 2603/2604 | S24P; V46E; S92G; S426W; R549L | ++++ |
| 2625/2626 | S24P; K36L; V46E; S99V; S426W; N532G; R549L | ++++ |
| 2623/2624 | S92G; V95S; Y485C; N532G; R549L; W560E | ++++ |
| 2613/2614 | S24P; K36L; P404A; E480L; Y485C; N532G; W560E; G600N | ++++ |
| 2641/2642 | S24P; N96M; P404A; S426W | ++++ |
| 2759/2760 | S24P; N96M; P404A; S426W; W560E | ++++ |
| 2635/2636 | K36L; P404A | ++++ |
| 2651/2652 | S24P; K36L; V95S; S99V; P404A; S426W; Y485C | ++++ |
| 2579/2580 | R549L | +++ |
| 2581/2582 | S24P | +++ |
| 2557/2558 | E480L | +++ |
| 2761/2762 | V296R | +++ |
| 2763/2764 | E480R | +++ |
| 2597/2598 | V95A | +++ |
| 2765/2766 | S24V | +++ |
| 2767/2768 | R120L | +++ |
| 2769/2770 | W560M | +++ |
| 2771/2772 | N78I | +++ |
| 2773/2774 | S92G | +++ |
| 2567/2568 | N532G | +++ |
| 2775/2776 | N96G | +++ |
| 2777/2778 | S258V | +++ |
| 2779/2780 | S361P | +++ |
| 2781/2782 | S626G | +++ |
| 2647/2648 | S24P; K36L; N96M; S99V; N532G; R549L | +++ |
| 2621/2622 | S24P; V46E; S99V; S426W; R549L; G600N | +++ |
| 2637/2638 | S24P; V46E; V95S; S99V; S426W; N532G | +++ |
| 2607/2608 | S24P; V46E; S92G; P404A; S426W; N532G | +++ |
| 2611/2612 | S24P; V46E; S92G; S426W; N532G | ++ |
| 2617/2618 | S24P; V46E; P404A; S426W; Y485C; N532G | ++ |
| 2783/2784 | S426W; Y485C | ++ |
| 2785/2786 | P404A | ++ |
| 2633/2634 | S24P; K36L; P404A; S426W; N532G | ++ |
| 2615/2616 | S24P; S99V | ++ |
| 2787/2788 | S426W; N532G; R549L | ++ |
| 2627/2628 | S99V; S426W; E480L; Y485C | ++ |
| 2789/2790 | S24P; N532G | ++ |
| 2791/2792 | R549L; W560E | ++ |
| 2645/2646 | S24P; P404A; E480L; Y485C | ++ |
| 2653/2654 | K36L; P404A; S426W; R549L; G600N | ++ |
| 2659/2660 | S24P; P404A; S426W; N532G | ++ |
| 2605/2606 | K36L; S426W; Y485C; G600N | ++ |
| 2793/2794 | P404A; S426W; Y485C | ++ |
| 2795/2796 | K36L; S99V; S426W; Y485C; G600N | ++ |
| 2797/2798 | S92G; P404A | ++ |
| 2799/2800 | A324F | ++ |
| 2593/2594 | S99V | ++ |
| 2565/2566 | N14R | ++ |
| 2801/2802 | N96M | ++ |
| 2561/2562 | K36L | ++ |
| 2803/2804 | N14R; S24P; S99L; R218M; D408Q; S537C; W560I | ++ |
| 2559/2560 | G600N | ++ |
| 2683/2684 | N14A; S24V; N78I; R120L; S258V | ++ |
| 2805/2806 | N14R; S537C | ++ |
| 2807/2808 | N14R; V46P; N96S; S99L; W560I | ++ |
| 2809/2810 | N14R; S92V; S99L; R218M; D408Q | ++ |
| 2663/2664 | V46P; S92V; W560I | ++ |
| 2665/2666 | N14L; S92V; N96S; R120S; R376M | ++ |
| 2671/2672 | N96S; S99L | ++ |
| 2811/2812 | N14L; R376M; S537C | ++ |
| 2725/2726 | N14A; V95R; R120L; V296R; E480R; W560M | ++ |
| 2661/2662 | S92V; S99L; R218M; W560I | ++ |
| 2813/2814 | N14L; S92V; S99L; R120S; R218M; D408R | ++ |
| 2815/2816 | N14R; S92C; N96S; R376M | ++ |
| 2817/2818 | N14L; R376M | ++ |
| 2685/2686 | N14A; S24V; K36P; N96G | ++ |
| 2819/2820 | S92V; R218M | ++ |
| 2705/2706 | N14A; S24V; S258V; W560M | ++ |
| 2821/2822 | N14R; S92V; N96S; S99L; R376M; W560I | ++ |
| 2823/2824 | N14L; S92C; R218M; D408Q | ++ |
| 2825/2826 | Q23A; K36L; N96G; D408L; T596V; Q640R | ++ |
| 2827/2828 | N14R; V46P; N47P; R376M | ++ |
| 2829/2830 | K36L; D408L | ++ |
| 2831/2832 | S92V; N96S | ++ |
| 2667/2668 | N14R; D408Q | ++ |
| 2833/2834 | N14L; R376M; W560I | ++ |
| 2699/2700 | K36P; S258V; V296R | ++ |
| 2687/2688 | S24V; V296R | ++ |
| 2721/2722 | N14A; S24V; K36P; V296R; G424W; W560M | ++ |
| 2835/2836 | V296R; E480R; W560M | ++ |
| 2675/2676 | N14R; S92V; S99L; R120S; S537C | ++ |
| 2729/2730 | K36L; D408L; S537W; T596Q | ++ |
| 2837/2838 | R120S; R376M | ++ |
| 2839/2840 | Q23A; K36L; S537W; N540R; Q640R | ++ |
| 2841/2842 | G424W | ++ |
| 2843/2844 | S92V; S99L; R120S | ++ |
| 2691/2692 | R120L; A324F; E480R; W560M | ++ |
| 2695/2696 | S24V; K36P; V95N; N96G | ++ |
| 2753/2754 | Q23A; K36L; S92C; V95F; S99F; D408L; T596V | ++ |
| 2709/2710 | V296R; A324F | ++ |
| 2845/2846 | K36L; V95F; N96G | ++ |
| 2711/2712 | V296R; A324F; W560M | ++ |
| 2755/2756 | V95F | ++ |
| 2697/2698 | S24V; K36P; R120L; V296R; E480R; W560M | ++ |
| 2723/2724 | K36P; S258V; V296R; A324F; S433G; S626G | ++ |
| 2847/2848 | Q23A; K36L | + |
| 2733/2734 | Q23A; K36L; S537W; T596Q | + |
| 2849/2850 | S99L; Q640R | + |
| 2731/2732 | Q23A; K36L; S92C; V95F; N96G | + |
| 2751/2752 | Q23A; K36L; D408L; N428H | + |
| 2851/2852 | R218G; S537W; T596V | + |
| 2735/2736 | K36L; S92C; V95F; N428H; T596Q | + |
| 2737/2738 | S537W; Q640R | + |
| 2853/2854 | Q640R | + |
| 2855/2856 | Q23A; R218G; T596V; Q640R | + |
| 2857/2858 | D408L; T596Q | + |
| 2859/2860 | R218G; T596Q | + |

† Activity (% conversion) was defined as follows: "+" 60.0 to 70.0, "++" 70.0 to 80.0, "+++" 80.0 to 90.0, "++++" 90.0 to 99.0

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (2860 sequences)

SEQ ID NO: 1 - DNA, 1965 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtacaaaagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgatttcgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaagtgataa

SEQ ID NO: 2 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYKSDNHAWLFGWKKGSVFQAGPSTAMNWYYTSGSGDVKSAGKRQSNRGVAPDAMCGNAVMYDAVKGKILTFGGSPDFEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 3 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 4 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 5 - DNA, 1965 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccacaggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaagtgataa

SEQ ID NO: 6 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPQEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 7 - DNA, 1965 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaagtgataa

SEQ ID NO: 8 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 9 - DNA, 1965 bp, Artificial Sequence; identical to SEQ ID NO: 7
  Variant of Galactose Oxidase from Fusarium graminearum

SEQ ID NO: 10 - protein, 653 aa, Artificial Sequence; identical to SEQ ID NO: 8
  Variant of Galactose Oxidase from Fusarium graminearum

SEQ ID NO: 11 - DNA, 1965 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaagtgataa

SEQ ID NO: 12 - protein, 653 aa, Artificial Sequence; identical to SEQ ID NO: 4
  Variant of Galactose Oxidase from Fusarium graminearum

SEQ ID NO: 13 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaaagccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 14 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGKPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 15 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 16 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 17 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacatcgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 18 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITSTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 19 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagaagtctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 20 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEKSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 21 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgtgacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 22 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCVTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 23 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtactacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 24 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGTTLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 25 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatgctaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 26 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYANDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 27 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcagtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 28 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCSDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 29 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctacgggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 30 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSTGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 31 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggagttccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 32 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGVPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 33 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtcttacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 34 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCLTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 35 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgccttgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 36 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCLDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 37 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtagctgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 38 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVAEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 39 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctggtggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 40 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSGGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 41 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcgcgggatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 42 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPARDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 43 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactcctaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 44 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTPTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 45 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcgatgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 46 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCDDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 47 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccggggataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 48 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTGDKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 49 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 50 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 51 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 52 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVVGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 53 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtattgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 54 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRIDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 55 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatactaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 56 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDTKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 57 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactggcgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 58 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLASSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 59 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcaatgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 60 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGNVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 61 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcgaggattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 62 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCEDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 63 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcacgtgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 64 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGTCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 65 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatggggcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 66 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNGAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 67 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacacagacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 68 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITQTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 69 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtatgggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 70 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVWEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 71 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgtctcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 72 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTSHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 73 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtctgtggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 74 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVCGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 75 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccaagtgccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 76 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 77 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccatgtgccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 78 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPCAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 79 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgagaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 80 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDEKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 81 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatacggcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 82 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNTAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 83 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacttctaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 84 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTSNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 85 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctaggggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 86 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSRGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 87 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcagcaggcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 88 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQQARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 89 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 90 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 91 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttccccttgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 92 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPLVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 93 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactcggaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 94 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTRTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 95 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtgctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 96 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGAPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 97 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtcaggatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 98 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 99 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgcgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 100 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIAPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 101 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgttaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 102 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTVNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 103 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtccgacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 104 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCPTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 105 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgacctcggataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 106 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTSDKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 107 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtatcggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 108 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 109 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaaggccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 110 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGRPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 111 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaactactttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 112 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTTLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 113 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtacgcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 114 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGTPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 115 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtggtacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 116 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCGTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 117 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtacttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 118 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVLEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 119 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgttcgacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 120 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCSTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 121 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtatggatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 122 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRMDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 123 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattctgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 124 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPILPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 125 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 126 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 127 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcaaggtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagcgccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 128 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGKVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 129 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgggcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 130 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIGRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 131 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggctctgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 132 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGSVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 133 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgtccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 134 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 135 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtggtcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 136 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGGPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 137 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgaccttttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 138 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDLFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 139 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcatggattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 140 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCMDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 141 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacagttacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 142 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITVTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 143 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggttgtacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 144 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGCTLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 145 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgtgtttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 146 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDVFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 147 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcagtatgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 148 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQYARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 149 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactcctaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 150 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTPNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 151 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtcgggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 152 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRRDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 153 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagagttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 154 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFESSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 155 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtaatttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 156 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGNFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 157 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggtttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 158 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGGFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 159 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 160 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 161 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatatggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 162 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYMDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 163 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaactaggttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 164 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTRLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 165 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 166 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 167 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgagttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 168 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 169 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 170 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 171 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggttcgttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 172 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGSFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 173 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaataaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 174 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVNKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 175 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattattttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 176 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYFDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 177 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaactgtgttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 178 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTVLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 179 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttcttaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 180 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVLKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 181 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaatggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 182 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPMEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 183 - DNA, 1959 bp, Artificial Sequence; identical to SEQ ID NO: 43
  Variant of Galactose Oxidase from Fusarium graminearum

SEQ ID NO: 184 - protein, 653 aa, Artificial Sequence; identical to SEQ ID NO: 44
  Variant of Galactose Oxidase from Fusarium graminearum

SEQ ID NO: 185 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcaaggattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 186 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCKDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 187 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaactatgttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 188 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTMLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 189 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 190 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 191 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttcataaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 192 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVHKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 193 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcacttgtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 194 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTCTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 195 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttatgaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 196 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVMKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 197 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccatctgccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 198 - protein, 653 aa, Artificial Sequence; identical to SEQ ID NO: 76
  Variant of Galactose Oxidase from Fusarium graminearum

SEQ ID NO: 199 - DNA, 1959 bp, Artificial Sequence; identical to SEQ ID NO: 111
  Variant of Galactose Oxidase from Fusarium graminearum

SEQ ID NO: 200 - protein, 653 aa, Artificial Sequence; identical to SEQ ID NO: 112
  Variant of Galactose Oxidase from Fusarium graminearum

SEQ ID NO: 201 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacttataaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 202 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTYNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 203 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcacttcgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 204 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 205 - DNA, 1959 bp, Artificial Sequence; identical to SEQ ID NO: 89
  Variant of Galactose Oxidase from Fusarium graminearum

SEQ ID NO: 206 - protein, 653 aa, Artificial Sequence; identical to SEQ ID NO: 90
  Variant of Galactose Oxidase from Fusarium graminearum

SEQ ID NO: 207 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattgttctgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccggacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 208 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGIVLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 209 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctagtggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 210 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSSGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 211 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcgcaggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 212 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVAGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 213 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagtcttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttaccccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 214 - protein, 653 aa, Artificial Sequence; identical to SEQ ID NO: 154
  Variant of Galactose Oxidase from Fusarium graminearum

SEQ ID NO: 215 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgaggtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 216 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGEVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 217 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgcgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 218 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTANHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 219 - DNA, 1959 bp, Artificial Sequence; identical to SEQ ID NO: 49
  Variant of Galactose Oxidase from Fusarium graminearum

SEQ ID NO: 220 - protein, 653 aa, Artificial Sequence; identical to SEQ ID NO: 50
  Variant of Galactose Oxidase from Fusarium graminearum

SEQ ID NO: 221 - DNA, 1959 bp, Artificial Sequence; identical to SEQ ID NO: 101
  Variant of Galactose Oxidase from Fusarium graminearum

SEQ ID NO: 222 - protein, 653 aa, Artificial Sequence; identical to SEQ ID NO: 102
  Variant of Galactose Oxidase from Fusarium graminearum

SEQ ID NO: 223 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtctcgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 224 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVSGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 225 - DNA, 1959 bp, Artificial Sequence; identical to SEQ ID NO: 107
  Variant of Galactose Oxidase from Fusarium graminearum

SEQ ID NO: 226 - protein, 653 aa, Artificial Sequence; identical to SEQ ID NO: 108
  Variant of Galactose Oxidase from Fusarium graminearum

SEQ ID NO: 227 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgctccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 228 - protein, 653 aa, Artificial Sequence; identical to SEQ ID NO: 100
  Variant of Galactose Oxidase from Fusarium graminearum

SEQ ID NO: 229 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagacttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 230 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFETSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 231 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 232 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGVCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 233 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctaatggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 234 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSNGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 235 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggccaggtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 236 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGQVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 237 - DNA, 1959 bp, Artificial Sequence; identical to SEQ ID NO: 131
  Variant of Galactose Oxidase from Fusarium graminearum

SEQ ID NO: 238 - protein, 653 aa, Artificial Sequence; identical to SEQ ID NO: 132
  Variant of Galactose Oxidase from Fusarium graminearum

SEQ ID NO: 239 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 240 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTMTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 241 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcgagggatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 242 - protein, 653 aa, Artificial Sequence; identical to SEQ ID NO: 42
  Variant of Galactose Oxidase from Fusarium graminearum

SEQ ID NO: 243 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctgcgggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 244 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSAGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 245 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactcagaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 246 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTQNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 247 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactggtaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 248 - protein, 653 aa, Artificial Sequence; identical to SEQ ID NO: 126
  Variant of Galactose Oxidase from Fusarium graminearum

SEQ ID NO: 249 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcgggggatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 250 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAGDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 251 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgcgacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 252 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 253 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgctcggattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 254 - protein, 653 aa, Artificial Sequence; identical to SEQ ID NO: 28
  Variant of Galactose Oxidase from Fusarium graminearum

SEQ ID NO: 255 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggacttcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 256 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWTSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 257 - DNA, 1959 bp, Artificial Sequence; identical to SEQ ID NO: 19
  Variant of Galactose Oxidase from Fusarium graminearum

SEQ ID NO: 258 - protein, 653 aa, Artificial Sequence; identical to SEQ ID NO: 20
  Variant of Galactose Oxidase from Fusarium graminearum

SEQ ID NO: 259 - DNA, 1959 bp, Artificial Sequence; identical to SEQ ID NO: 97
  Variant of Galactose Oxidase from Fusarium graminearum

SEQ ID NO: 260 - protein, 653 aa, Artificial Sequence; identical to SEQ ID NO: 98
  Variant of Galactose Oxidase from Fusarium graminearum

SEQ ID NO: 261 - DNA, 1959 bp, Artificial Sequence; identical to SEQ ID NO: 45
  Variant of Galactose Oxidase from Fusarium graminearum

SEQ ID NO: 262 - protein, 653 aa, Artificial Sequence; identical to SEQ ID NO: 46
  Variant of Galactose Oxidase from Fusarium graminearum

SEQ ID NO: 263 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtagtacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 264 - protein, 653 aa, Artificial Sequence; identical to SEQ ID NO: 120
  Variant of Galactose Oxidase from Fusarium graminearum

SEQ ID NO: 265 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgtattcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcactcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 266 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGVFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSITRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 267 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaactgtgttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 268 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTVLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 269 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 270 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 271 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 272 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 273 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 274 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 275 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 276 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 277 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 278 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 279 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattctgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 280 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPILPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 281 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccgctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 282 - protein, 653 aa, Artificial Sequence; identical to SEQ ID NO: 274
  Variant of Galactose Oxidase from Fusarium graminearum

SEQ ID NO: 283 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 284 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 285 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 286 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 287 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 288 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 289 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 290 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 291 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 292 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 293 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 294 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 295 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattctgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccgcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 296 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPILPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 297 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 298 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 299 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 300 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 301 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 302 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 303 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 304 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 305 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 306 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 307 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 308 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVVGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 309 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 310 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 311 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 312 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 313 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 314 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 315 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 316 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 317 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 318 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 319 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 320 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTSTVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 321 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcacttgcaccgttaccaaacacgacatgttttgccccggtatctcgatggacgggaacggtcagatcgtggtcactggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcctgtgccgcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 322 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTCTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCRDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 323 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 324 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 325 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 326 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 327 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 328 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGGFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 329 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 330 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 331 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtagtccgggcggtattactgctacgagctcatgggaccctagcactggaattgtatccgatcgcactgtaaccgttaccaaacacgacatgttttgccccggtatctcgatggacgggaacggtcagatcgtggtcgctggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcctgtgccgcgattgtactcagaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 332 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITATSSWDPSTGIVSDRTVTVTKHDMFCPGISMDGNGQIVVAGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCRDCTQNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 333 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtacgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 334 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSTTMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 335 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 336 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 337 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 338 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 339 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 340 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 341 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 342 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 343 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 344 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 345 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 346 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 347 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 348 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 349 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccatcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtaaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 350 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 351 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 352 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 353 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 354 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 355 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttcgcctggcggtattacactgacgagctcatgggaccctagcactggaattgtatccgatcgcactgtgaccgttaccaaacacgacatgttttgccccggtatctcgatggacgggaacggtcagatcgtggtcactggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgagcgcagtgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatatggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcagaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 356 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGERSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYMDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 357 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 358 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 359 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccatcggccgccgcaattgagccaacgagcggtcgtgtcttgatgtggagctcttatcgtcaggatgcttttgagggttctcctggcggtattacactgacgagctcatgggaccctagcactggaattgtatccgatcgcactgtaaccgttaccaaacacgacatgttttgccccggtatctcgatggacgggaacggtcagatcgtggtcgctggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 360 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTVTVTKHDMFCPGISMDGNGQIVVAGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 361 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 362 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGGFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 363 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 364 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTMTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 365 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 366 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 367 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 368 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 369 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 370 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 371 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 372 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 373 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 374 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTMTVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 375 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 376 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 377 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattctgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 378 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPILPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 379 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 380 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVVGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 381 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 382 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 383 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 384 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTMTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 385 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 386 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVVGGNDAKKTSLYDSSSDSWIPGPDMQVARGYQSSATMSDGRVFTIGGSFSGGGVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 387 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 388 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 389 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 390 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 391 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatattgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 392 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 393 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttatcgttaccaaacacgacaatttttgccccggtatctcgatggacgggaacggtcagatcgtggtcgctggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 394 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVIVTKHDNFCPGISMDGNGQIVVAGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 395 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcacttgcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 396 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTCTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 397 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 398 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 399 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 400 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 401 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcagccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgcggcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 402 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGSRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGVCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 403 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 404 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 405 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 406 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 407 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 408 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 409 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 410 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 411 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgcggcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 412 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGVCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 413 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgttgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 414 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 415 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 416 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTMTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 417 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcatatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 418 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRIFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 419 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 420 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVVGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 421 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactatgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 422 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTMTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 423 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcctgtgccacgattgtactcagaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 424 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCHDCTQNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 425 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtcgccctggcggtattacactgacgagctcatgggaccctagcactggaattgtatccgatcgcactgttaccgttaccaaacacgacatgttttgccccggtatctcgatggacgggaacggtcagatcgtggtcactggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgggagcagtgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcagaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 426 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGRPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGSSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 427 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 428 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 429 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatcaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 430 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYQDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 431 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtaaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgccgcgattgtactcagaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 432 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGVCRDCTQNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 433 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 434 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 435 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 436 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 437 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 438 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 439 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaatggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 440 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPMEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 441 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcagccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 442 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGSRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 443 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcagccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagctgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcctgtgcggcgattgtactcagaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 444 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGSRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTQNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 445 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccatttgcccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 446 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPICPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 447 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgggcgcagtgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatatggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcagaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 448 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYMDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 449 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccatcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 450 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 451 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 452 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 453 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 454 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 455 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacaatttttgccccggtatctcgatggacgggaacggtcagatcgtggtcactggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 456 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDNFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 457 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtcaggatgcttttgagggttctcctggcggtattactctgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcagccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgcggcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 458 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGSRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGVCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 459 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattactctgacgagctcatgggaccctagcactggaattgtatccgatcgcactgtaaccgttaccaaacacgacatgttttgccccggtatctcgatggacgggaacggtcagatcgtggtcgctggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggccggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagctgaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcgtgtgccgcgattgtactactaatcactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 460 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVAGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGVCRDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 461 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 462 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 463 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtcgccctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgggaactttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcagaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 464 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGRPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGNFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 465 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggtgcgcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcgagcgcagtgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcagaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 466 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGAPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGERSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 467 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgctttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcggccgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 468 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVVGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 469 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacaagtacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 470 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITSTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 471 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcggttcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgtaacgattgtacgacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 472 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCNDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 473 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactactaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 474 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 475 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgtgaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 476 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 477 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcgtgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 478 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTVTVTKHDMFCPGISMDGNGQIVVVGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 479 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgttccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgttaccgttaccaaacacgacatgttttgccccggtatctcgatggacgggaacggtcagatcgtggtcacgggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtggcgttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 480 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTVTVTKHDMFCPGISMDGNGQIVVTGGNDAKKTSLYDSSSDSWIPGPDMQVARGYQSSATMSDGRVFTIGGSFSGGGVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 481 - DNA, 1959 bp, Artificial Sequence
  Variant of Galactose Oxidase from Fusarium graminearum
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtactgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaatttgagaagaacggggaggtttactccccgagctcgaagacttggacttctctgccgaatgcaaaagttaaccccatgctgaccgccgataaacagggtttgtaccgttcggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccagcggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 482 - protein, 653 aa, Artificial Sequence
  Variant of Galactose Oxidase from Fusarium graminearum
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRTDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEFEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPAEDSTPVFTPEIYVPEQDTFYKQNPNSIVRAYHSISLLLPDGRVFNGGGGLCGDCAGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 483 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggcgaggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtgctacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 484 - protein, 653 aa, Artificial Sequence; identical to SEQ ID NO: 294
  Variant of Galactose Ox

SEQ ID NO: 485 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggcgaggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactgggaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 486 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTGNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 487 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcgaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 488 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 489 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaggtgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 490 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 491 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 492 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 493 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtacggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 494 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 495 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 496 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 497 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgataccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 498 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 499 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgttataaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 500 - protein, 653 aa, Artificial Sequence
  Variant of Galactose Ox
MASAPIGSAIPRNNWAVTCDSAQSGNECYKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 501 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 502 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 503 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 504 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 505 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 506 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 507 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacggcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 508 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTAPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 509 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactaccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccactaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 510 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTTTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 511 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 512 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 513 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 514 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 515 - DNA, 1959 bp, Artificial Sequence
  Variant of Galactose Ox
atggcatcagcgccgatcgggtccgccatcccgcgcaacaactgggccgttacatgcgattccgcccaggaggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 516 - protein, 653 aa, Artificial Sequence
  Variant of Galactose Ox
MASAPIGSAIPRNNWAVTCDSAQEGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 517 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcacaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 518 - protein, 653 aa, Artificial Sequence
  Variant of Galactose Ox
MASAPIGSAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 519 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 520 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 521 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgttgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 522 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 523 - DNA, 1959 bp, Artificial Sequence
  Variant of Galactose Ox
atggcatcagcgccgatcgggtccgccatcccgcgcaacaactgggccgttacatgcgattccgcccaggcggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 524 - protein, 653 aa, Artificial Sequence
  Variant of Galactose Ox
MASAPIGSAIPRNNWAVTCDSAQAGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 525 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 526 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 527 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactgtccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 528 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 529 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcacggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 530 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRTEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 531 - DNA, 1959 bp, Artificial Sequence
  Variant of Galactose Ox
atggcatcagcgccgatcgggtccgccatcccgcgcaacaactgggccgttacatgcgattccgcccagcctgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgtggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 532 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 533 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 534 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 535 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtacctataccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 536 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTYTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 537 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcggattcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 538 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSDSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 539 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 540 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 541 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 542 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 543 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattcctttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 544 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 545 - DNA, 1959 bp, Artificial Sequence
  Variant of Galactose Ox
atggcatcagcgccgatcgggtccgccatcccgcgcaacaactgggccgttacatgcgattccgcccagcaggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccaacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 546 - protein, 653 aa, Artificial Sequence
  Variant of Galactose Ox
MASAPIGSAIPRNNWAVTCDSAQQGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 547 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgtgaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 548 - protein, 653 aa, Artificial Sequence
  Variant of Galactose Ox
MASAPIGSAIPRNNWAVTCDSAQSGNECNKAIDGNKDTFWHTFYGVNGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 549 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgtgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 550 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 551 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccgtgagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 552 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 553 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaatccggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 554 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 555 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 556 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 557 - DNA, 1959 bp, Artificial Sequence
  Variant of Galactose Ox
atggcatcagcgccgatcggggtggccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 558 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 559 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 560 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 561 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 562 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 563 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccacagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggagggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 564 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 565 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagcccatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 566 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEAHGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 567 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactcagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 568 - protein, 653 aa, Artificial Sequence
  Variant of Galactose Ox
MASAPIGSAIPRNNWAVTCDSAQSGNECNKAIDGNKDTFWHTQYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 569 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 570 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 571 - DNA, 1959 bp, Artificial Sequence
  Variant of Galactose Ox
atggcatcacagccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 572 - protein, 653 aa, Artificial Sequence
  Variant of Galactose Ox
MASQPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 573 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgacatgtcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 574 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDMSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 575 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 576 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 577 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 578 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDEFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 579 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccagacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 580 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITQTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 581 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggttcggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 582 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 583 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 584 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 585 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactgcttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 586 - protein, 653 aa, Artificial Sequence
  Variant of Galactose Ox
MASAPIGSAIPRNNWAVTCDSAQSGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 587 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagtttctcccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 588 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 589 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 590 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 591 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 592 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 593 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 594 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 595 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 596 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 597 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 598 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 599 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 600 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 601 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 602 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 603 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 604 - protein, 653 aa, Artificial Sequence
  Variant of Galactose Ox
MASAPIGSAIPRNNWAVTCDSAQSGNECNKAIDGNKDTFWHTAYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 605 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 606 - protein, 653 aa, Artificial Sequence
  Variant of Galactose Ox
MASAPIGSAIPRNNWAVTCDSAQPGNECNKAIDGNPDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 607 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 608 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 609 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 610 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 611 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 612 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 613 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 614 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 615 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 616 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 617 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 618 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 619 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactcaatatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtgatgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 620 - protein, 653 aa, Artificial Sequence
  Variant of Galactose Ox
MASAPIGSAIPRNNWAVTCDSAQSGNECNKAIDGNPDTFWHTQYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGDVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 621 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 622 - protein, 653 aa, Artificial Sequence
  Variant of Galactose Ox
MASAPIGSAIPRNNWAVTCDSAQSGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 623 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 624 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVRPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 625 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 626 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 627 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 628 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 629 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 630 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 631 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 632 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 633 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 634 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 635 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactcaatatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtacctacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 636 - protein, 653 aa, Artificial Sequence
  Variant of Galactose Ox
MASAPIGSAIPRNNWAVTCDSAQSGNECNKAIDGNKDTFWHTQYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTYTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 637 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 638 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 639 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgaagttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 640 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGEVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 641 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 642 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 643 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 644 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 645 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 646 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 647 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaggacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtgatgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 648 - protein, 653 aa, Artificial Sequence
  Variant of Galactose Ox
MASAPIGSAIPRNNWAVTCDSAQSGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGDVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 649 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 650 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 651 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactcaatatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 652 - protein, 653 aa, Artificial Sequence
  Variant of Galactose Ox
MASAPIGSAIPRNNWAVTCDSAQPGNECNKAIDGNKDTFWHTQYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 653 - DNA, 1959 bp, Artificial Sequence
  Variant of Galactose Ox
atggcatcagcgccgatcgggtccgccatcccgcgcaacaactggagtgttacatgcgattccgcccaggcggggaatgaatgtaacaaggcaattgacggtaataaagacacgttttggcacactgagtatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactctggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 654 - protein, 653 aa, Artificial Sequence
  Variant of Galactose Ox
MASAPIGSAIPRNNWSVTCDSAQAGNECNKAIDGNKDTFWHTEYGANGDPKPPHTFTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTLEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 655 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactgagtatggtgccaacggagatcccaaaccgccgcacacctatacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 656 - protein, 653 aa, Artificial Sequence
  Variant of Galactose Ox
MASAPIGSAIPRNNWAVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 657 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 658 - protein, 653 aa, Artificial Sequence
  Variant of Galactose Ox
MASAPIGSAIPRNNWSVTCDSAQSGNECNKAIDGNKDTFWHTEYGANGDPKPPHTFTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 659 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 660 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 661 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 662 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 663 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 664 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 665 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 666 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 667 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 668 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGREEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 669 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 670 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 671 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 672 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 673 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 674 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQEEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 675 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 676 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 677 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctttacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgaggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 678 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTVQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTEEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 679 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 680 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 681 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 682 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 683 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 684 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 685 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgaggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 686 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 687 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccgttagcttgttgttgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 688 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPFEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 689 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactgagtatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 690 - protein, 653 aa, Artificial Sequence
  Variant of Galactose Ox
MASAPIGSAIPRNNWAVTCDSAQSGNECNKAIDGNKDTFWHTEYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 691 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 692 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 693 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 694 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 695 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 696 - protein, 653 aa, Artificial Sequence
  Variant of Galactose Ox
MASAPIGSAIPRNNWAVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 697 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 698 - protein, 653 aa, Artificial Sequence
  Variant of Galactose Ox
MASAPIGSAIPRNNWEVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 699 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactgagtatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 700 - protein, 653 aa, Artificial Sequence
  Variant of Galactose Ox
MASAPIGSAIPRNNWAVTCDSAQSGNECNKAIDGNKDTFWHTEYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 701 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 702 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 703 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactgagtatggtgccaacggagatcccaaaccgccgcacacctatacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 704 - protein, 653 aa, Artificial Sequence
  Variant of Galactose Ox
MASAPIGSAIPRNNWEVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 705 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 706 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 707 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaactcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 708 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTSSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 709 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtacgaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgtcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 710 - protein, 653 aa, Artificial Sequence
  Variant of Galactose Ox
MASAPIGIAIPRNNWAVTCDSAQSGNECTKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 711 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactacgagtgatgggcgcgtatttacgattggcggcagtttttccggcggtcgcactgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaggatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacagttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 712 - protein, 653 aa, Artificial Sequence
  Variant of Galactose Ox
MASAPIGIAIPRNNWAVTCDSAQSGNECNKAIDGNKDTFWHTFYGVNGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATTSDGRVFTIGGSFSGGRTEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 713 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgtcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 714 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITRTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 715 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaggatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacatgtcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 716 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTSSVKVGGRITISTDMSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 717 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 718 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 719 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtacgaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactacgagtgatgggcgcgtatttacgattggcggcagtttttccggcggtcgcgtcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccaatcagtcaaggtcggcgggcgcatcaccatttcaactgacatgtcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 720 - protein, 653 aa, Artificial Sequence
  Variant of Galactose Ox
MASAPIGSAIPRNNWAVTCDSAQSGNECTKAIDGNKDTFWHTFYGVNGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSLDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITRTSTQSVKVGGRITISTDMSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 721 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgtggtgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactacgagtgatgggcgcgtatttacgattggcggcagtttttccggcggtcgcactgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccatttgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacgaataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 722 - protein, 653 aa, Artificial Sequence
  Variant of Galactose Ox
MASAPIGSAIPRNNWAVTCDSAQSGNECNKAIDGNKDTFWHTFYGVNGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMWCPGISMDGNGQIVVTGGNDAKKTSLYDSSSDSWIPGPDMQVARGYQSSATTSDGRVFTIGGSFSGGRTEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPFEDSTPVFTPEIYVPEQDTFYKQNPNSIVRAYHSISLLLPDGRVFNGGGGLCGDCTTNHFDAQIFTPNYLYDSNGNLATRPKITRTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 723 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctacacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccaggcccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 724 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQARGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 725 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcggcggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 726 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDGFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISAASLIRYGTATHTVNTDQRRIPLTLTNEGGNSYSFQVPSDSGVALPGYWMLFVMNSAGVPSVASTIRVTQGGGGSWSHPQFEK

SEQ ID NO: 727 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaaccagttcagtcaaggtcggcgggaccatcaccatttcaactgactcttcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 728 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDEFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTSSVKVGGTITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 729 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 730 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 731 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 732 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 733 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaggacacgttttggcacactcaatatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 734 - protein, 653 aa, Artificial Sequence
  Variant of Galactose Ox
MASAPIGSAIPRNNWAVTCDSAQSGNECNKAIDGNKDTFWHTQYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 735 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 736 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 737 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 738 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 739 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 740 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 741 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtgaagttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 742 - protein, 653 aa, Artificial Sequence
  Variant of Galactose Ox
MASAPIGSAIPRNNWAVTCDSAQPGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGEVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 743 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttactattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 744 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 745 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtacctacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 746 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTYTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 747 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtgatgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 748 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGDVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 749 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 750 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 751 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 752 - protein, 653 aa, Artificial Sequence; identical to SEQ ID NO: 626
  Variant of Galactose Ox

SEQ ID NO: 753 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtgatgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 754 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGDVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 755 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtacctacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 756 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTYTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 757 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 758 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 759 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactgcgtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 760 - protein, 653 aa, Artificial Sequence
  Variant of Galactose Ox
MASAPIGSAIPRNNWAVTCDSAQPGNECNKAIDGNKDTFWHTAYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 761 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 762 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 763 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactcaatatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtacctacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 764 - protein, 653 aa, Artificial Sequence
  Variant of Galactose Ox
MASAPIGSAIPRNNWAVTCDSAQSGNECNKAIDGNPDTFWHTQYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTYTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 765 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttcgccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 766 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 767 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 768 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 769 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 770 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 771 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 772 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 773 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaatccagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgtgttgagaagaacggggaggtttactccccgagctcgaagacttggacttctctgccgaatgcaaaagttagccccatgctgaccgccgataaacagggtttgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccttcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 774 - protein, 653 aa, Artificial Sequence
  Variant of Galactose Ox
MASAPIGSAIPRNNWAVTCDSAQSGNECNKAIDGNPDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSFSLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 775 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgcggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 776 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 777 - DNA, 1959 bp, Artificial Sequence
  Variant of Galactose Ox
atggcatcagcgccgatcgggtccgccatcccgcgcaacaactgggccgttacatgcgattccgcccagccggggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgacaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccaggggggcgggggtagctggtctcacccacagttcgaaaag

SEQ ID NO: 778 - protein, 653 aa, Artificial Sequence
  Variant of Galactose Ox
MASAPIGSAIPRNNWAVTCDSAQPGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGGGGSWSHPQFEK

SEQ ID NO: 779 - DNA, 1959 bp, Artificial Sequence
  Variant of Galactose Ox
atggcatcagcgccgatcgggtccgccatcccgcgcaacaactgggccgttacatgcgattccgcccagtcggggaatgaatgtaacaaggcaattgacggtaataaggacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgtgaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgtatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 780 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 781 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 782 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 783 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 784 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 785 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 786 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 787 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 788 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGREEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 789 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttttatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 790 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 791 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 792 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 793 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 794 - protein, 653 aa, Artificial Sequence
  Variant of Galactose Ox
MASAPIGSAIPRNNWEVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 795 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 796 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 797 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 798 - protein, 653 aa, Artificial Sequence
  Variant of Galactose Ox
MASAPIGSAIPRNNWAVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 799 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 800 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 801 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttctatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 802 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 803 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 804 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 805 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 806 - protein, 653 aa, Artificial Sequence
  Variant of Galactose Ox
MASAPIGSAIPRNNWEVTCDSAQSGNECNKAIDGNKDTFWHTEYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 807 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 808 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGSEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 809 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 810 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 811 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 812 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 813 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 814 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 815 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 816 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 817 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtagtgtggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 818 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 819 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 820 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 821 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 822 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 823 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 824 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 825 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 826 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 827 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 828 - protein, 653 aa, Artificial Sequence
  Variant of Galactose Ox
MASAPIGSAIPRNNWEVTCDSAQSGNECNKAIDGNKDTFWHTFYGANGDPKPPHTFTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 829 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 830 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 831 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 832 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 833 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 834 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 835 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactgcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtgtttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 836 - protein, 653 aa, Artificial Sequence
  Variant of Galactose Ox
MASAPIGSAIPRNNWSVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYCPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 837 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 838 - protein, 653 aa, Artificial Sequence
  Variant of Galactose Ox
MASAPIGSAIPRNNWAVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 839 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctttacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 840 - protein, 653 aa, Artificial Sequence
  Variant of Galactose Ox
MASAPIGSAIPRNNWEVTCDSAQSGNECNKAIDGNKDTFWHTFYGANGDPKPPHTFTIDMKTTQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 841 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 842 - protein, 653 aa, Artificial Sequence
  Variant of Galactose Ox
MASAPIGSAIPRNNWEVTCDSAQSGNECNKAIDGNKDTFWHTEYGANGDPKPPHTYTIDMKTTQNVNGLSVLPRQDGNQNGWIGRHEVYLSSDGTNWGSPVAIGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 843 - DNA, 1959 bp, Artificial Sequence
  Variant of Galactose Ox
atggcatcagcgccgatcgggtccgccatcccgcgcaacaactgggcggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 844 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 845 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttctatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcgcgcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 846 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFRASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 847 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactgagtatggtgccaacggagatcccaaaccgccgcacacctatacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgattgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 848 - protein, 653 aa, Artificial Sequence
  Variant of Galactose Ox
MASAPIGSAIPRNNWSVTCDSAQSGNECNKAIDGNKDTFWHTEYGANGDPKPPHTYTIDMKTVQNVNGLSVLPRQDGNQNGWIGRHEVYLSSDGTNWGSPVAIGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 849 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttacagcccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 850 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 851 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 852 - protein, 653 aa, Artificial Sequence
  Variant of Galactose Ox
MASAPIGSAIPRNNWEVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 853 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 854 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 855 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactgagtatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtactgaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 856 - protein, 653 aa, Artificial Sequence
  Variant of Galactose Ox
MASAPIGSAIPRNNWEVTCDSAQSGNECNKAIDGNKDTFWHTEYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGTEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 857 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactgagaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtagtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 858 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVTGGNDAKKTSLYDSSSDSWIPGPDMQVARGYQSSATMSDGRVFTIGGSFSGGSVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 859 - DNA, 1959 bp, Artificial Sequence
  Variant of Galactose Ox
atggcatcagcgccgatcgggtccgccatcccgcgcaacaactgggaggttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggaggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 860 - protein, 653 aa, Artificial Sequence
  Variant of Galactose Ox
MASAPIGSAIPRNNWEVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQEEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 861 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcaggtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccattagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 862 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 863 - DNA, 1959 bp, Artificial Sequence
  Variant of Galactose Ox
atggcatcagcgccgatcgggtccgccatcccgcgcaacaactggagtgttacatgcgattccgcccagagtgggaatgaatgtaacaaggcaattgacggtaataaagacacgttttggcacactttttatggtgccaacggagatcccaaaccgccgcacacctttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgagtgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagcaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgtgtggagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccgttagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 864 - protein, 653 aa, Artificial Sequence
  Variant of Galactose Ox
MASAPIGSAIPRNNWSVTCDSAQSGNECNKAIDGNKDTFWHTFYGANGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSVSLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 865 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgttacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaggatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgacagttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 866 - protein, 653 aa, Artificial Sequence
  Variant of Galactose Ox
MASAPIGSAIPRNNWAVTCDSAQSGNECYKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 867 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgttacaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgtcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacagttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 868 - protein, 653 aa, Artificial Sequence
  Variant of Galactose Ox
MASAPIGIAIPRNNWAVTCDSAQSGNECYKAIDGNKDTFWHTFYGVNGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 869 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 870 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 871 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgacagttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 872 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 873 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcactgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacgaataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 874 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRTEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 875 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtacgaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacgaataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 876 - protein, 653 aa, Artificial Sequence
  Variant of Galactose Ox
MASAPIGSAIPRNNWAVTCDSAQSGNECTKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 877 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaggatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 878 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 879 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtacgaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 880 - protein, 653 aa, Artificial Sequence
  Variant of Galactose Ox
MASAPIGSAIPRNNWAVTCDSAQSGNECTKAIDGNKDTFWHTFYGVNGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 881 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactacgagtgatgggcgcgtatttacgattggcggcagtttttccggcggtcgcactgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacatgtcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 882 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATTSDGRVFTIGGSFSGGRTEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTSSVKVGGRITISTDMSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 883 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 884 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSLDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 885 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtacgaaggcaattgacggtaataaagacacgttttggcacactttttatggtgttaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagtgtagatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacggataacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 886 - protein, 653 aa, Artificial Sequence
  Variant of Galactose Ox
MASAPIGSAIPRNNWAVTCDSAQSGNECTKAIDGNKDTFWHTFYGVNGDPKPPHTYTIDMKTTQNVNGLSVLPRQDGNQNGWIGRHEVYLSVDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTDNGGNSYSFQVPSDSGVALPGYWMLFVMNSAGVPSVASTIRVTQGGGGSWSHPQFEK

SEQ ID NO: 887 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgctaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgatggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcctggactcttggattccgggcccggatatgcaggtcgcgcgtgggtatcaatcaagtgcgactacgagtgatgggcgcgtatttacgattggcggcagtttttccggcggtcgcgtcgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctgggagtggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacagttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 888 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFDGSPGGITLTSSWDPSTGIVSDRTSTVTKHDMFCPGISMDGNGQIVVTGGNDAKKTSLYDSSLDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 889 - DNA, 1959 bp, Artificial Sequence
  Variant of Galactose Ox
atggcatcagcgccgatcgggatcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttcggatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgaaggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagcagcgactcttggattccgggcccggatatgcaggtcgcgcgtgggtatcaatcaagtgcgactacgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtttgtaccgtagcgataatcatgcttggctgtttgggtggaaaaaaggtagcgtcttccaagcaggtccaagtactgccatgaattggtattatacatctggggaaggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgccgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaagacgatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaaccagttcagtcaaggtcggcgggcgcatcaccatttcaactgacagttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 890 - protein, 653 aa, Artificial Sequence
  Variant of Galactose Ox
MASAPIGIAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGEGDVKSAGKRQSNRGVAPDAMCGNAVMYDAVKGKILTFGGSPDYEDSDATTNAHIITLGEPGTPPNTVFASNGLYFARTFHTSVVLPDGSTFITGGQRRGIPTEDSTPVFTPEIYVPEDDTFYKQNPNSIVRAYHSISLLLPDGRVFNGGGGLCGDCTTNHFDAQIFTPNYLYDSNGNLATRPKITGTSTSSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 891 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctacacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcggcggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 892 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDEFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISAASLIRYGTATHTVNTDQRRIPLTLTNEGGNSYSFQVPSDSGVALPGYWMLFVMNSAGVPSVASTIRVTQGGGGSWSHPQFEK

SEQ ID NO: 893 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 894 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 895 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccaggcccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 896 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDEFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQARGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 897 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 898 - protein, 653 aa, Artificial Sequence
  Variant of Galactose Ox
MASAPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDGFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 899 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcggattcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 900 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSDSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 901 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccaggcccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaggcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 902 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDEFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQARGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 903 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 904 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 905 - DNA, 1959 bp, Artificial Sequence
  Variant of Galactose Ox
atggcatcacaaccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgaactcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcggcggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 906 - protein, 653 aa, Artificial Sequence
  Variant of Galactose Ox
MASQPIGSAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDGFEGSPGGITLTSSWDPSTGIVSDRTSTVTKHDMFCPGISMDGNGQIVVTGGNDAKKTSLYDSNSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISAASLIRYGTATHTVNTDQRRIPLTLTNEGGNSYSFQVPSDSGVALPGYWMLFVMNSAGVPSVASTIRVTQGGGGSWSHPQFEK

SEQ ID NO: 907 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 908 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 909 - DNA, 1959 bp, Artificial Sequence
  Variant of Galactose Ox
atggcatcagcgccgatcgggtccgccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 910 - protein, 653 aa, Artificial Sequence
  Variant of Galactose Ox
MASAPIGSAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 911 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 912 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDGFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 913 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 914 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDGFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 915 - DNA, 1959 bp, Artificial Sequence
  Variant of Galactose Ox
atggcatcagcgccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgaactcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccaggcccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 916 - protein, 653 aa, Artificial Sequence
  Variant of Galactose Ox
MASAPIGSAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDGFEGSPGGITLTSSWDPSTGIVSDRTSTVTKHDMFCPGISMDGNGQIVVSGGNDAKKTSLYDSNSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQARGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGGGGSWSHPQFEK

SEQ ID NO: 917 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcttttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggaccatcaccatttcaactgactcttcaatctcggcggcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 918 - protein, 653 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGTITISTDSSISAASLIRYGTATHTVNTDQRRIPLTLTNLGGNSYSFQVPSDSGVALPGYWMLFVMNSAGVPSVASTIRVTQGGGGSWSHPQFEK

SEQ ID NO: 919 - DNA, 1959 bp, Artificial Sequence
  Variant of Galactose Ox
atggcatcacaaccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgagtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtgcgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 920 - protein, 653 aa, Artificial Sequence
  Variant of Galactose Ox
MASQPIGSAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDEFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGAYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 921 - DNA, 1959 bp, Artificial Sequence
  Variant of Galactose Ox
atggcatcacaaccgatcgggagcgccatcccgcgcaacaactgggccgttacatgcgattccgcccagagtgggaatgaatgtaacaaggcaattgacggtaataaagacacgttttggcacactttttatggtgccaacggagatcccaaaccgccgcacacctacacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggcgcatcaccatttcaactgactcttcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 922 - protein, 653 aa, Artificial Sequence
  Variant of Galactose Ox
MASQPIGSAIPRNNWAVTCDSAQSGNECNKAIDGNKDTFWHTFYGANGDPKPPHTYTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDGFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNEGGNSYSFQVPSDSGVALPGYWMLFVMNSAGVPSVASTIRVTQGGGGSWSHPQFEK

SEQ ID NO: 923 - DNA, 1959 bp, Artificial Sequence
  Variant of Galactose Ox
atggcatcacaaccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcgccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 924 - protein, 653 aa, Artificial Sequence
  Variant of Galactose Ox
MASQPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVTGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQRRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNLGGNSYSFQVPSDSGVALPGYWMLFVMNSAGVPSVASTIRVTQGGGGSWSHPQFEK

SEQ ID NO: 925 - DNA, 1959 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaacgatgggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaccggtggtaatgatgcaaagaaaacttccttatatgattcggattcagactcttggattccgggcccggatatgcaggtcgcgcgtgggtatcaatcaagtgcgactatgagtgatgggcgcgtatttacgattggcggcagtttttccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccaggcccgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccaatcagtcaaggtcggcgggaccatcaccatttcaactgactcttcaatctcgaaggcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccaggggggcgggggtagctggtctcacccacagttcgaaaag

SEQ ID NO: 926 - protein, 653 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDGFEGSPGGITLTSSWDPSTGIVSDRTSTVTKHDMFCPGISMDGNGQIVVTGGNDAKKTSLYDSDSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQARGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGTITISTDSSISKASLIRYGTATHTVNTDQRRIPLTLTNLGGNSYSFQVPSDSGVALPGYWMLFVMNSAGVPSVASTIRVTQGGGGSWSHPQFEK

SEQ ID NO: 927 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 928 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 929 - DNA, 1953 bp, Artificial Sequence
  Variant of Galactose Ox
atggcatcacagccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 930 - protein, 650 aa, Artificial Sequence
  Variant of Galactose Ox
MASQPIGVAIPRNNWAVTCDSAQSGNECNKAIDGNKDTFWHTQYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 931 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 932 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 933 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgatggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggtggatcaccatttcaactgacatgtcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 934 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFDGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDMSISKASLIRYGTATHTVNTDQRRIPLTLTNNGGNSYSFQVPSDSGVALPGYWMLFVMNSAGVPSVASTIRVTQGQTGHHHHHH

SEQ ID NO: 935 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccttcacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgccgcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactctgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggcgcatcaccatttcaactgactcgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 936 - protein, 650 aa, Artificial Sequence
  Variant of Galactose Ox
MASAPIGVAIPRNNWAVTCDSAQSGNECNKAIDGNKDTFWHTQYGVNGDPKPPHTFTIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISAASLIRYGTATHTVNTDQRRIPLTLTNNGGNSYSFQVPSDSGVALPGYWMLFVMNSAGVPSVASTIRVTQGQTGHHHHHH

SEQ ID NO: 937 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgcaaacggagatcccaaaccgccgcacaccatcacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactctgagtgatgggcgcgtatttacgattggcggcagtttctccggcggtcgtgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggtggatcaccatttcaactgacatgtcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 938 - protein, 650 aa, Artificial Sequence
  Variant of Galactose Ox
MASAPIGVAIPRNNWAVTCDSAQSGNECNKAIDGNKDTFWHTQYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATLSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDMSISKASLIRYGTATHTVNTDQRRIPLTLTNNGGNSYSFQVPSDSGVALPGYWMLFVMNSAGVPSVASTIRVTQGQTGHHHHHH

SEQ ID NO: 939 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 940 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 941 - DNA, 1953 bp, Artificial Sequence
  Variant of Galactose Ox
atggcatcacagccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccttcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactctgagtgatgggcgcgtatttacgattggcggcagtttctccggcggtactgttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggcgtatcaccatttcaactgacatgtcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 942 - protein, 650 aa, Artificial Sequence
  Variant of Galactose Ox
MASQPIGVAIPRNNWAVTCDSAQSGNECNKAIDGNKDTFWHTQYGVNGDPKPPHTFTIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATLSDGRVFTIGGSFSGGTVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDMSISKASLIRYGTATHTVNTDQRRIPLTLTNEGGNSYSFQVPSDSGVALPGYWMLFVMNSAGVPSVASTIRVTQGQTGHHHHHH

SEQ ID NO: 943 - DNA, 1953 bp, Artificial Sequence
  Variant of Galactose Ox
atggcatcacagccgatcggggtagccatcccgcgcaacaactgggccgttacatgcgattccgcccagagtgggaatgaatgtaacaaggcaattgacggtaataaagacacgttttggcacactcaatatggtgcaaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttgccgcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgatggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactctgagtgatgggcgcgtatttacgattggcggcagtttctccggcggtcgtgttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggctgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 944 - protein, 650 aa, Artificial Sequence
  Variant of Galactose Ox
MASQPIGVAIPRNNWAVTCDSAQSGNECNKAIDGNKDTFWHTQYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFAASSYTAPQPGLGRWGPTIDLPIVPAAAAIEPTSGRVLMWSSYRQDAFDGSPGGITLTSSWDPSTGIVSDRTSTVTKHDMFCPGISMDGNGQIVVSGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGLGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 945 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactttttatggtgtaaacggagatcccaaaccgccgcacaccatcacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgtgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgactcgtcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 946 - protein, 650 aa, Artificial Sequence
  Variant of Galactose Ox
MASAPIGVAIPRNNWAVTCDSAQSGNECNKAIDGNKDTFWHTFYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 947 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggcgcatcaccatttcaactgactcgtcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 948 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGRITISTDSSISKASLIRYGTATHTVNTDQRRIPLTLTNEGGNSYSFQVPSDSGVALPGYWMLFVMNSAGVPSVASTIRVTQGQTGHHHHHH

SEQ ID NO: 949 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactttttatggtgcaaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactctgagtgatgggcgcgtatttacgattggcggcagtttctccggcggtcgtgttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggtggatcaccatttcaactgactcgtcaatctcgaaagcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 950 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATLSDGRVFTIGGSFSGGRVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 951 - DNA, 1953 bp, Artificial Sequence
  Variant of Galactose Ox
atggcatcacagccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcaaggtcggcgggtggatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 952 - protein, 650 aa, Artificial Sequence
  Variant of Galactose Ox
MASQPIGVAIPRNNWAVTCDSAQSGNECNKAIDGNKDTFWHTQYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 953 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgtaaacggagatcccaaaccgccgcacaccatcacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtactgttgagaagaacggggaggtttactccccgagctcgaagacttggacttctctgccgaatgcaaaagttagccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 954 - protein, 650 aa, Artificial Sequence
  Variant of Galactose Ox
MASAPIGVAIPRNNWAVTCDSAQSGNECNKAIDGNKDTFWHTFYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGTVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 955 - DNA, 1953 bp, Artificial Sequence
  Variant of Galactose Ox
atggcatcagcgccgatcggggtagccatcccgcgcaacaactggtcggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 956 - protein, 650 aa, Artificial Sequence
  Variant of Galactose Ox
MASAPIGVAIPRNNWSVTCDSAQSGNECNKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 957 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 958 - protein, 650 aa, Artificial Sequence
  Variant of Galactose Ox
MASAPIGVAIPRNNWEVTCDSAQSGNECNKAIDGNPDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTILVTQGQTGHHHHHH

SEQ ID NO: 959 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgaatatggtgccaacggagatcccaaaccgccgcacaccgttacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 960 - protein, 650 aa, Artificial Sequence
  Variant of Galactose Ox
MASAPIGVAIPRNNWEVTCDSAQSGNECNKAIDGNKDTFWHTEYGANGDPKPPHTVTIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTILVTQGQTGHHHHHH

SEQ ID NO: 961 - DNA, 1953 bp, Artificial Sequence
  Variant of Galactose Ox
atggcatcagcgccgatcggggtagccatcccgcgcaacaactggtcggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 962 - protein, 650 aa, Artificial Sequence
  Variant of Galactose Ox
MASAPIGVAIPRNNWSVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTILVTQGQTGHHHHHH

SEQ ID NO: 963 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 964 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDNGGNSYSFQVPSDSGVALPGYWMLFVMNSAGVPSVASTILVTQGQTGHHHHHH

SEQ ID NO: 965 - DNA, 1953 bp, Artificial Sequence
  Variant of Galactose Ox
atggcatcagcgccgatcggggtagccatcccgcgcaacaactgggaggttacatgcgattccgcccagtcggggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 966 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNLGGNSYSFQVPSDSGVALPGYWMLFVMNSAGVPSVASTIRVTQGQTGHHHHHH

SEQ ID NO: 967 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 968 - protein, 650 aa, Artificial Sequence
  Variant of Galactose Ox
MASAPIGVAIPRNNWEVTCDSAQSGNECNKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 969 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtgctgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 970 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 971 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 972 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 973 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 974 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 975 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtagtgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 976 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 977 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaatccagacacgttttggcacactgcatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 978 - protein, 650 aa, Artificial Sequence
  Variant of Galactose Ox
MASAPIGVAIPRNNWEVTCDSAQSGNECNKAIDGNPDTFWHTAYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTILVTQGQTGHHHHHH

SEQ ID NO: 979 - DNA, 1953 bp, Artificial Sequence
  Variant of Galactose Ox
atggcatcagcgccgatcggggtagccatcccgcgcaacaactgggcggttacatgcgattccgcccagagtgggaatgaatgtaacaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 980 - protein, 650 aa, Artificial Sequence
  Variant of Galactose Ox
MASAPIGVAIPRNNWAVTCDSAQSGNECNKAIDGNPDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 981 - DNA, 1953 bp, Artificial Sequence
  Variant of Galactose Ox
atggcatcagcgccgatcggggtagccatcccgcgcaacaactgggaggttacatgcgattccgcccagagtgggaatgaatgttacaaggcaattgacggtaataaggacacgttttggcacactttctatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 982 - protein, 650 aa, Artificial Sequence
  Variant of Galactose Ox
MASAPIGVAIPRNNWEVTCDSAQSGNECYKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 983 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 984 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNLGGNSYSFQVPSDSGVALPGYWMLFVMNSAGVPSVASTILVTQGQTGHHHHHH

SEQ ID NO: 985 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 986 - protein, 650 aa, Artificial Sequence
  Variant of Galactose Ox
MASAPIGVAIPRNNWEVTCDSAQSGNECNKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 987 - DNA, 1953 bp, Artificial Sequence
  Variant of Galactose Ox
atggcatcagcgccgatcggggtagccatcccgcgcaacaactgggaggttacatgcgattccgcccagagtgggaatgaatgttacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 988 - protein, 650 aa, Artificial Sequence
  Variant of Galactose Ox
MASAPIGVAIPRNNWEVTCDSAQSGNECYKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 989 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 990 - protein, 650 aa, Artificial Sequence
  Variant of Galactose Ox
MASAPIGVAIPRNNWEVTCDSAQSGNECNKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 991 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 992 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 993 - DNA, 1953 bp, Artificial Sequence
  Variant of Galactose Ox
atggcatcagcgccgatcggggtagccatcccgcgcaacaactgggaggttacatgcgattccgcccagccggggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 994 - protein, 650 aa, Artificial Sequence
  Variant of Galactose Ox
MASAPIGVAIPRNNWEVTCDSAQPGNECNKAIDGNKDTFWHTEYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 995 - DNA, 1953 bp, Artificial Sequence
  Variant of Galactose Ox
atggcatcagcgccgatcggggtagccatcccgcgcaacaactgggaggttacatgcgattccgcccagagtgggaatgaatgttacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtagtgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 996 - protein, 650 aa, Artificial Sequence
  Variant of Galactose Ox
MASAPIGVAIPRNNWEVTCDSAQSGNECYKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 997 - DNA, 1953 bp, Artificial Sequence
  Variant of Galactose Ox
atggcatcagcgccgatcggggtagccatcccgcgcaacaactgggaggttacatgcgattccgcccagtcggggaatgaatgttacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 998 - protein, 650 aa, Artificial Sequence
  Variant of Galactose Ox
MASAPIGVAIPRNNWEVTCDSAQSGNECYKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 999 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1000 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1001 - DNA, 1953 bp, Artificial Sequence
  Variant of Galactose Ox
atggcatcagcgccgatcggggtagccatcccgcgcaacaactgggaggttacatgcgattccgcccagccggggaatgaatgttacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1002 - protein, 650 aa, Artificial Sequence
  Variant of Galactose Ox
MASAPIGVAIPRNNWEVTCDSAQPGNECYKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1003 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgcatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1004 - protein, 650 aa, Artificial Sequence
  Variant of Galactose Ox
MASAPIGVAIPRNNWEVTCDSAQSGNECNKAIDGNKDTFWHTAYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1005 - DNA, 1953 bp, Artificial Sequence
  Variant of Galactose Ox
atggcatcagcgccgatcggggtagccatcccgcgcaacaactgggaggttacatgcgattccgcccagagtgggaatgaatgttacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1006 - protein, 650 aa, Artificial Sequence
  Variant of Galactose Ox
MASAPIGVAIPRNNWEVTCDSAQSGNECYKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1007 - DNA, 1953 bp, Artificial Sequence
  Variant of Galactose Ox
atggcatcagcgccgatcggggtagccatcccgcgcaacaactggtcggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1008 - protein, 650 aa, Artificial Sequence
  Variant of Galactose Ox
MASAPIGVAIPRNNWSVTCDSAQSGNECNKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTILVTQGQTGHHHHHH

SEQ ID NO: 1009 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgcatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1010 - protein, 650 aa, Artificial Sequence
  Variant of Galactose Ox
MASAPIGVAIPRNNWEVTCDSAQSGNECNKAIDGNKDTFWHTAYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1011 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1012 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1013 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1014 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTILVTQGQTGHHHHHH

SEQ ID NO: 1015 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1016 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1017 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1018 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1019 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1020 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1021 - DNA, 1953 bp, Artificial Sequence
  Variant of Galactose Ox
atggcatcagcgccgatcggggtagccatcccgcgcaacaactgggaggttacatgcgattccgcccagtcggggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1022 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1023 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttctatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1024 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1025 - DNA, 1953 bp, Artificial Sequence
  Variant of Galactose Ox
atggcatcagcgccgatcggggtagccatcccgcgcaacaactggtcggttacatgcgattccgcccagagtgggaatgaatgttacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1026 - protein, 650 aa, Artificial Sequence
  Variant of Galactose Ox
MASAPIGVAIPRNNWSVTCDSAQSGNECYKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1027 - DNA, 1953 bp, Artificial Sequence
  Variant of Galactose Ox
atggcatcagcgccgatcggggtagccatcccgcgcaacaactgggaggttacatgcgattccgcccagccggggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1028 - protein, 650 aa, Artificial Sequence
  Variant of Galactose Ox
MASAPIGVAIPRNNWEVTCDSAQPGNECNKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1029 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactgcatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1030 - protein, 650 aa, Artificial Sequence
  Variant of Galactose Ox
MASAPIGVAIPRNNWEVTCDSAQSGNECTKAIDGNKDTFWHTAYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1031 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1032 - protein, 650 aa, Artificial Sequence
  Variant of Galactose Ox
MASAPIGVAIPRNNWEVTCDSAQSGNECTKAIDGNPDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTILVTQGQTGHHHHHH

SEQ ID NO: 1033 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1034 - protein, 650 aa, Artificial Sequence
  Variant of Galactose Ox
MASAPIGVAIPRNNWEVTCDSAQSGNECTKAIDGNPDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1035 - DNA, 1953 bp, Artificial Sequence
  Variant of Galactose Ox
atggcatcagcgccgatcggggtagccatcccgcgcaacaactgggaggttacatgcgattccgcccagagtgggaatgaatgttacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1036 - protein, 650 aa, Artificial Sequence
  Variant of Galactose Ox
MASAPIGVAIPRNNWEVTCDSAQSGNECYKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1037 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1038 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1039 - DNA, 1953 bp, Artificial Sequence
  Variant of Galactose Ox
atggcatcagcgccgatcggggtagccatcccgcgcaacaactgggaggttacatgcgattccgcccagccggggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1040 - protein, 650 aa, Artificial Sequence
  Variant of Galactose Ox
MASAPIGVAIPRNNWEVTCDSAQPGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1041 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtagtgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1042 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1043 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1044 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 1045 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtagtgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1046 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 1047 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1048 - protein, 650 aa, Artificial Sequence
  Variant of Galactose Ox
MASAPIGVAIPRNNWEVTCDSAQSGNECNKAIDGNPDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTDLGGNSYSFQVPSDSGVALPGYWMLFVMNSAGVPSVASTILVTQGQTGHHHHHH

SEQ ID NO: 1049 - DNA, 1953 bp, Artificial Sequence
  Variant of Galactose Ox
atggcatcagcgccgatcggggtagccatcccgcgcaacaactgggaggttacatgcgattccgcccagccggggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1050 - protein, 650 aa, Artificial Sequence
  Variant of Galactose Ox
MASAPIGVAIPRNNWEVTCDSAQPGNECTKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 1051 - DNA, 1953 bp, Artificial Sequence
  Variant of Galactose Ox
atggcatcagcgccgatcggggtagccatcccgcgcaacaactgggaggttacatgcgattccgcccagtcggggaatgaatgtactaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1052 - protein, 650 aa, Artificial Sequence
  Variant of Galactose Ox
MASAPIGVAIPRNNWEVTCDSAQSGNECTKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1053 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1054 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNLGGNSYSFQVPSDSGVALPGYWMLFVMNSAGVPSVASTIRVTQGQTGHHHHHH

SEQ ID NO: 1055 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1056 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 1057 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaggacacgttttggcacactttctatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1058 - protein, 650 aa, Artificial Sequence
  Variant of Galactose Ox
MASAPIGVAIPRNNWEVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1059 - DNA, 1953 bp, Artificial Sequence
  Variant of Galactose Ox
atggcatcagcgccgatcggggtagccatcccgcgcaacaactggtcggttacatgcgattccgcccagtcggggaatgaatgtactaaggcaattgacggtaataaagacacgttttggcacactttctatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1060 - protein, 650 aa, Artificial Sequence
  Variant of Galactose Ox
MASAPIGVAIPRNNWSVTCDSAQSGNECTKAIDGNKDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1061 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaataaagacacgttttggcacactgcatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1062 - protein, 650 aa, Artificial Sequence
  Variant of Galactose Ox
MASAPIGVAIPRNNWEVTCDSAQSGNECNKAIDGNKDTFWHTAYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDLGGNSYSFQVPSDSGVALPGYWMLFVMNSAGVPSVASTIRVTQGQTGHHHHHH

SEQ ID NO: 1063 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtaacaaggcaattgacggtaatccagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtgatgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactgagaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1064 - protein, 650 aa, Artificial Sequence
  Variant of Galactose Ox
MASAPIGVAIPRNNWEVTCDSAQSGNECNKAIDGNPDTFWHTFYGANGDPKPPHTITIDMKTTQNVNGLSVLPRQDGNQNGWIGRHEVYLSDDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETDTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1065 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagtagtgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1066 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNLGGNSYSFQVPSDSGVALPGYWMLFVMNSAGVPSVASTILVTQGQTGHHHHHH

SEQ ID NO: 1067 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttctatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactgagaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttggctggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1068 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1069 - DNA, 1953 bp, Artificial Sequence
  Variant of Galactose Ox
atggcatcagcgccgatcggggtagccatcccgcgcaacaactgggaggttacatgcgattccgcccagccggggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgtcaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactacgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1070 - protein, 650 aa, Artificial Sequence
  Variant of Galactose Ox
MASAPIGVAIPRNNWEVTCDSAQPGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATTSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1071 - DNA, 1953 bp, Artificial Sequence
  Variant of Galactose Ox
atggcatcagcgccgatcggggtagccatcccgcgcaacaactgggaggttacatgcgattccgcccagagtgggaatgaatgtactaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtaatgatgcgtttgagggttctcctggcggtattacactgacgagctcatgggaccctagcactggaattgtatccgatcgcactagtaccgacaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1072 - protein, 650 aa, Artificial Sequence
  Variant of Galactose Ox
MASAPIGVAIPRNNWEVTCDSAQSGNECTKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRNDAFEGSPGGITLTSSWDPSTGIVSDRTSTDTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTILVTQGQTGHHHHHH

SEQ ID NO: 1073 - DNA, 1953 bp, Artificial Sequence
  Variant of Galactose Ox
atggcatcagcgccgatcggggtagccatcccgcgcaacaactggtcggttacatgcgattccgcccagagtgggaatgaatgtaacaaggcaattgacggtaataaagacacgttttggcacactgaatatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaagatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttcgtcccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacctggacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacctgggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1074 - protein, 650 aa, Artificial Sequence
  Variant of Galactose Ox
MASAPIGVAIPRNNWSVTCDSAQSGNECNKAIDGNKDTFWHTEYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVRPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGRITISTDSSISKASLIRYGTATHTVNTDQRRIPLTLTNLGGNSYSFQVPSDSGVALPGYWMLFVMNSAGVPSVASTIRVTQGQTGHHHHHH

SEQ ID NO: 1075 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactgagaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgggcgcagtgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatatcgattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaggcgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1076 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGGRSEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1077 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgagcgcgtggagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1078 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGERVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1079 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagtaatgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1080 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1081 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagtaatgggaacttagccactcgccctaaaatcacccgcacctcaacccagtcagtcaaggtcggcgggcgcatcaccatttcaactgactcttcaatctcgaaggcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1082 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1083 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagtgatgggaacttagccactcgccctaaaatcacccgcacctcaacccagtcagtcaaggtcggcgggcgcatcaccatttcaactgactcgtcaatctcgaaggcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1084 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSDGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1085 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacagtacaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatggtgatgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1086 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDGDGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGQTGHHHHHH

SEQ ID NO: 1087 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaaaaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgacatgtcaatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1088 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1089 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1090 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1091 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatggtaatgggaacttagccactcgccctaaaatcacccgcacctcaacccagtcagtcaaggtcggcgggcgcatcaccatttcaactgactcgtcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1092 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDGNGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGQTGHHHHHH

SEQ ID NO: 1093 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgacatgtcaatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1094 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1095 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagtgatgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1096 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1097 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgacatgtcaatctcgaaggcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1098 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDMSISKASLIRYGTATHTVNTDQRRIPLTLTNEGGNSYSFQVPSDSGVALPGYWMLFVMNSAGVPSVASTIRVTQGQTGHHHHHH

SEQ ID NO: 1099 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaggacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagtgatgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1100 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSDGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1101 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaggcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1102 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1103 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1104 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1105 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaatgttgacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatggtgatgggaacttagccactcgccctaaaatcacccgcacctcaacccagtcagtcaaggtcggcgggcgcatcaccatttcaactgactcgtcaatctcgaaggcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1106 - protein, 650 aa, Artificial Sequence
  Variant of Galactose Ox
MASAPIGVAIPRNNWAVTCDSAQSGNECNKAIDGNVDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDGDGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1107 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaatgttgacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagcaatgggaacttagccactcgccctaaaatcacccgcacctcaacccagtcagtcaaggtcggcgggcgcatcaccatttcaactgacatgtcaatctcggccgcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1108 - protein, 650 aa, Artificial Sequence
  Variant of Galactose Ox
MASAPIGVAIPRNNWAVTCDSAQSGNECNKAIDGNVDTFWHTFYGANGDPKPPHTITIDMKTTQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDMSISAASLIRYGTATHTVNTDQRRIPLTLTDEGGNSYSFQVPSDSGVALPGYWMLFVMNSAGVPSVASTIRVTQGQTGHHHHHH

SEQ ID NO: 1109 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaaaaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatggtgatgggaacttagccactcgccctaaaatcacccgcacctcaacccagtcagtcaaggtcggcgggcgcatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1110 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDGDGNLATRPKITRTSTQSVKVGGRITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1111 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1112 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1113 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaatgttgacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatggtgatgggaacttagccactcgccctaaaatcacccgcacctcaacccagtcagtcaaggtcggcgggcgcatcaccatttcaactgactcgtcaatctcggccgcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1114 - protein, 650 aa, Artificial Sequence
  Variant of Galactose Ox
MASAPIGVAIPRNNWAVTCDSAQSGNECNKAIDGNVDTFWHTFYGANGDPKPPHTITIDMKTTQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDGDGNLATRPKITRTSTQSVKVGGRITISTDSSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1115 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcgtcaatctcggccgcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1116 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1117 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1118 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1119 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagtaatgggaacttagccactcgccctaaaatcacccgcacctcaacccagtcagtcaaggtcggcgggcgcatcaccatttcaactgactcgtcaatctcgaaggcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1120 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1121 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1122 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1123 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcgtcaatctcggccgcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1124 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISAASLIRYGTATHTVNTDQRRIPLTLTNEGGNSYSFQVPSDSGVALPGYWMLFVMNSAGVPSVASTIRVTQGQTGHHHHHH

SEQ ID NO: 1125 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtcacaaggcaattgacggtaataaagacacgttttggcacactttttatggtgccaacggagatcccaaaccgccgcacaccattacgatcgatatgaaaacagtacaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccgcggggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacggacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1126 - protein, 650 aa, Artificial Sequence
  Variant of Galactose Ox
MASAPIGVAIPRNNWAVTCDSAQSGNECHKAIDGNKDTFWHTFYGANGDPKPPHTITIDMKTVQNVNGLSVLPRQDGNQNGWIGRHEVYLSSDGTNWGSPVASGSWFADSTTKYSNFETRPARYVRLVAITEAAGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDEGGNSYSFQVPSDSGVALPGYWMLFVMNSAGVPSVASTIRVTQGQTGHHHHHH

SEQ ID NO: 1127 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaacgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaaaaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatggtgatgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1128 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDGDGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGQTGHHHHHH

SEQ ID NO: 1129 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatcgtttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1130 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDRFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1131 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccaaattatctttacgatagcaacgggaacttagccactcgccctaaaatcacccgcacctcaacccagtcagtcaaggtcggcgggcgcatcaccatttcaactgactctgagatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1132 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSEISKASLIRYGTATHTVNTDQRRIPLTLTNNGGNSYSFQVPSDSGVALPGYWMLFVMNSAGVPSVASTIRVTQGQTGHHHHHH

SEQ ID NO: 1133 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttaccctcaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1134 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYPQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1135 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcgctgtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1136 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVAVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1137 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcgttgtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1138 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1139 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactctccgatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1140 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSPISKASLIRYGTATHTVNTDQRRIPLTLTNNGGNSYSFQVPSDSGVALPGYWMLFVMNSAGVPSVASTIRVTQGQTGHHHHHH

SEQ ID NO: 1141 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttggactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1142 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITIWTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1143 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatggggagaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1144 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGENWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1145 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaggggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1146 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1147 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccattgatactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1148 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITIDTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1149 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccattgagactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1150 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITIETDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1151 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccggatgacagcggggttgctcttccgggatactggatgttgttcgttatgaattccgctggtgtaccctccgttgcgtcgacgattcgtgttacccagggccaaactggccaccatcaccatcaccattag

SEQ ID NO: 1152 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPDDSGVALPGYWMLFVMNSAGVPSVASTIRVTQGQTGHHHHHH

SEQ ID NO: 1153 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcggggaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1154 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFAGNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1155 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgatcacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1156 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTDHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1157 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccattactactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1158 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITITTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1159 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaagggggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1160 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKGGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1161 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcagtgtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1162 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVSVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1163 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcgtcaatctcgaaggcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1164 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTDNGGNSYSFQVPSDSGVALPGYWMLFVMNSAGVPSVASTIRVTQGQTGHHHHHH

SEQ ID NO: 1165 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaatgttgacacgttttggcacactttttatggtgccaacggagatcccaaaccgccgcacaccattacgatcgatatgaaaacagtacaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaaaaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgccacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaggcaagtttaattcgctacggaactgctactcacacggtgaacaccgatcagcgccgcatcccgttgacgttaacgaacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1166 - protein, 650 aa, Artificial Sequence
  Variant of Galactose Ox
MASAPIGVAIPRNNWAVTCDSAQSGNECNKAIDGNVDTFWHTFYGANGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1167 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacgaaggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1168 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNEGGNSYSFQVPSDSGVALPGYWMLFVMNSAGVPSVASTIRVTQGQTGHHHHHH

SEQ ID NO: 1169 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcgtggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1170 - protein, 650 aa, Artificial Sequence; identical to SEQ ID NO: 1138
  Variant of Galactose Ox

SEQ ID NO: 1171 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcgatatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1172 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRIDISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1173 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagataggttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1174 - protein, 650 aa, Artificial Sequence; identical to SEQ ID NO: 1130
  Variant of Galactose Ox

SEQ ID NO: 1175 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactctgatatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1176 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSDISKASLIRYGTATHTVNTDQRRIPLTLTNNGGNSYSFQVPSDSGVALPGYWMLFVMNSAGVPSVASTIRVTQGQTGHHHHHH

SEQ ID NO: 1177 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1178 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1179 - DNA, 1953 bp, Artificial Sequence; identical to SEQ ID NO: 1139
  Variant of Galactose Ox

SEQ ID NO: 1180 - protein, 650 aa, Artificial Sequence; identical to SEQ ID NO: 1140
  Variant of Galactose Ox

SEQ ID NO: 1181 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcgctggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1182 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVAGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1183 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcacggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1184 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVTVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1185 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgagcgcgtggagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatatggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaggcgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1186 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGERVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYMDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1187 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactatgaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgagcgcgtggagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaggcgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1188 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTMTVTKHDMFCPGISMDGNGQIVVSGGNDAKKTSLYDSSSDSWIPGPDMQVARGYQSSATMSDGRVFTIGGSFSGERVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1189 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactgagaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgagcgcagtgagaagaacggggaggtttactccccgagctcgaagacttggacttctctgccgaatgcaaaagttaaccccatgctgaccgccgataaacagggtctgtaccgtcaggataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaagattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaaccgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1190 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTETVTKHDMFCPGISMDGNGQIVVSGGNDAKKTSLYDSSSDSWIPGPDMQVARGYQSSATMSDGRVFTIGGSFSGERSEKNGEVYSPSSKTWTSLPNAKVNPMLTADKQGLYRQDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1191 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcgggcgcgtggagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgtggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaggcgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggtgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1192 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYVDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1193 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgctacccagggccaaactggccaccatcaccatcaccattag

SEQ ID NO: 1194 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRATQGQTGHHHHHH

SEQ ID NO: 1195 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacagcgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttctgggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1196 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTAQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFLGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1197 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagaggtctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgtcatgaattccgctggtgtaccctccgttgcgtcgacgattcgtgttacccagggccaaactggccaccatcaccatcaccattag

SEQ ID NO: 1198 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFERSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1199 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatcgttttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1200 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDRFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1201 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgcgggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1202 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFAGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1203 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtactcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtgatccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1204 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGTPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVILPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1205 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagcagtctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1206 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEQSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1207 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagccttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1208 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEPSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1209 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttaggggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1210 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFRGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1211 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttcttggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1212 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFLGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1213 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggattggtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1214 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDWFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1215 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcggtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1216 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGGFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1217 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaggcgtctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1218 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEASPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1219 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacgtggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1220 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKRGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1221 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtgggcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1222 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGGPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1223 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagttgccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1224 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPVAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1225 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgggggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1226 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFGGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1227 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagcgcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1228 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSAYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1229 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcgcgttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1230 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGAFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1231 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttcgggggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1232 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFGGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1233 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttcagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1234 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFQGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1235 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgtgggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1236 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFVGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1237 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttattggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1238 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFIGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1239 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgtttttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1240 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDVFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1241 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggtacgcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1242 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGTPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1243 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1244 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1245 - DNA, 1953 bp, Artificial Sequence
  Variant of Galactose Ox
atggcatcagcgccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacaccattacgatcgatatgaaaacaacgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaagcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaggagtctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcgcgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtccggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgcacctcaacccagtcagtcaaggtcggcgggcgcatcaccatttcaactgactcttcaatctcgaaagcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1246 - protein, 650 aa, Artificial Sequence
  Variant of Galactose Ox
MASAPIGVAIPRNNWAVTCDSAQSGNECNKAIDGNKDTFWHTFYGANGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEESPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGRVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGRITISTDSSISKASLIRYGTATHTVNTDQRRIPLTLTNNGGNSYSFQVPSDSGVALPGYWMLFVMNSAGVPSVASTIRVTQGQTGHHHHHH

SEQ ID NO: 1247 - DNA, 1953 bp, Artificial Sequence
  Variant of Galactose Ox
atggcatcagcaccgatcggggtagccatcccgcgcaacaactgggaagttacatgcgattccgcccagagtgggaatgaatgtaacaaggcaattgacggtaataaagacacgttttggcacactgcttatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaaggttctcctggcggtattacactgacgagctcatgggaccctagcactggaattgtatccgatcgcactatgaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttctccggcgggcaggttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaaccgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1248 - protein, 650 aa, Artificial Sequence
  Variant of Galactose Ox
MASAPIGVAIPRNNWEVTCDSAQSGNECNKAIDGNKDTFWHTAYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTMTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITRTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1249 - DNA, 1953 bp, Artificial Sequence
  Variant of Galactose Ox
atggcatcagcaccgatcggggtagccatcccgcgcaacaactgggaagttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaaggttctcctggcggtattacactgacgagctcatgggaccctagcactggaattgtatccgatcgcacttcgaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttctccggcgggcaggttgagaagaacggggaggtttactccccgagctcgaagacttggacttctctgccgaatgcaaaagttaatcccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaggtgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacctggacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1250 - protein, 650 aa, Artificial Sequence
  Variant of Galactose Ox
MASAPIGVAIPRNNWEVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSDGNLATRPKITWTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1251 - DNA, 1953 bp, Artificial Sequence
  Variant of Galactose Ox
atggcatcagcaccgatcggggtagccatcccgcgcaacaactgggcagttacatgcgattccgcccagagtgggaatgaatgtaacaaggcaattgacggtaataaagacacgttttggcacactgcttatggtgtaaacggagatcccaaaccgccgcacaccatcacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaaggttctcctggcggtattacactgacgagctcatgggaccctagcactggaattgtatccgatcgcacttcgaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttctccggcgggcaggttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatatcgattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaggtgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacctggacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1252 - protein, 650 aa, Artificial Sequence
  Variant of Galactose Ox
MASAPIGVAIPRNNWAVTCDSAQSGNECNKAIDGNKDTFWHTAYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSDGNLATRPKITWTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1253 - DNA, 1953 bp, Artificial Sequence
  Variant of Galactose Ox
atggcatcagcaccgatcggggtagccatcccgcgcaacaactgggcagttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactatgaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcgagagtgttgagaagaacggggaggtttactccccgagctcgaagacttggacttctctgccgaatgcaaaagttagtcccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatatcgattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaggtgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacctggacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1254 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTMTVTKHDMFCPGISMDGNGQIVVSGGNDAKKTSLYDSSLDSWIPGPDMQVARGYQSSATMSDGRVFTIGGSFSGESVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYIDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSDGNLATRPKITWTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1255 - DNA, 1953 bp, Artificial Sequence
  Variant of Galactose Ox
atggcatcagcaccgatcggggtagccatcccgcgcaacaactgggcagttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaatcgagccaacgagcggtcgtgtcttgatgtggagctcttatcgtcaggatgcgtttgagggttctcctggcggtattacactgacgagctcatgggaccctagcactggaattgtatccgatcgcacttcgaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttctccggcgggcaggttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaaccgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacctggacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1256 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITWTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1257 - DNA, 1953 bp, Artificial Sequence
  Variant of Galactose Ox
atggcatcagcaccgatcggggtagccatcccgcgcaacaactgggcagttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaaggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagcgactcttggattccgggcccggatacgcaggtcgcgcgtgggtatcaatcaagtgcgactatgagtgatgggcgcgtatttacgattggcggcagtttctctggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1258 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDTQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1259 - DNA, 1953 bp, Artificial Sequence
  Variant of Galactose Ox
atggcatcagcaccgatcggggtagccatcccgcgcaacaactgggcagttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtgcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgaaggttctcctggcggtattacactgacgagctcatgggaccctagcactggaattgtatccgatcgcacttcgaccgttaccaaacacgacatgttttgccccggtatctcgatggacgggaacggtcagatcgtggtcagcggtggtaatgatgcaaagaaaacttccttatatgattcgagcagcgactcttggattccgggcccggatatgcaggtcgcgcgtgggtatcaatcaagtgcgactatgagtgatgggcgcgtatttacgattggcggcagtttctccggcgggcaggttgagaagaacggggaggtttactccccgagctcgaagacttggacttctctgccgaatgcaaaagttagtcccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaggtgaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaatgggaacttagccactcgccctaaaatcacctggacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattctggttacccagggccaaactggccaccatcaccatcaccattag

SEQ ID NO: 1260 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVSPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPGEDSTPVFTPEIYVPEQDTFYKQNPNSIVRAYHSISLLLPDGRVFNGGGGLCGDCTTNHFDAQIFTPNYLYDSNGNLATRPKITWTSTQSVKVGGWITISTDMSISAASLIRYGTATHTVNTDQRRIPLTLTNNGGNSYSFQVPSDSGVALPGYWMLFVMNSAGVPSVASTILVTQGQTGHHHHHH

SEQ ID NO: 1261 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacaactcaaaacgtgaatggcctttctgtactgccacgtcaggatggcaatcagaatggatggatcggacgtcacgaggtgtatttaagttctgatggggagaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaggcggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccattgatactgacatgccgatctcggccgcaagtttaattcgctacggaactgctactcacacggtgaacaccgatcagcgccgcatcccgttgacgttaacgaacaacggaggtaattcgtacagctttcaagttccggatgacagcggggttgctcttccgggatactggatgttgttcgttatgaattccgctggtgtaccctccgttgcgtcgacgattcgtgttacccagggccaaactggccaccatcaccatcaccattag

SEQ ID NO: 1262 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTTQNVNGLSVLPRQDGNQNGWIGRHEVYLSSDGENWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKGGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITIDTDMPISAASLIRYGTATHTVNTDQRRIPLTLTNNGGNSYSFQVPDDSGVALPGYWMLFVMNSAGVPSVASTIRVTQGQTGHHHHHH

SEQ ID NO: 1263 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1264 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1265 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1266 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1267 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttcaactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1268 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1269 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatggggagaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccggatgacagcggggttgctcttccgggatactggatgttgttcgttatgaattccgctggtgtaccctccgttgcgtcgacgattcgtgttacccagggccaaactggccaccatcaccatcaccattag

SEQ ID NO: 1270 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGENWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITISTDMSISAASLIRYGTATHTVNTDQRRIPLTLTNNGGNSYSFQVPDDSGVALPGYWMLFVMNSAGVPSVASTIRVTQGQTGHHHHHH

SEQ ID NO: 1271 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacaactcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1272 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTTQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1273 - DNA, 1953 bp, Artificial Sequence
  Variant of Galactose Ox
atggcatcagcaccgatcggggtagccatcccgcgcaacaactgggccgttaagtgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagccgccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1274 - protein, 650 aa, Artificial Sequence
  Variant of Galactose Ox
MASAPIGVAIPRNNWAVKCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1275 - DNA, 1953 bp, Artificial Sequence
  Variant of Galactose Ox
atggcatcagcaccgatcggggtagccatcccgcgcaacaactgggccgttacatgcgattccgcccagccggggaatgaatgtaacaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgataccaaacacgacatgttttgccccggtatctcgatggacgggaatggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgcgacgaaccactttgatgcgcaaatctttacgccgaattatctttacgatagcaacgggaacttagccactcgccctaaaatcacccgcacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1276 - protein, 650 aa, Artificial Sequence
  Variant of Galactose Ox
MASAPIGVAIPRNNWAVTCDSAQPGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1277 - DNA, 1953 bp, Artificial Sequence
  Variant of Galactose Ox
atggcatcagcaccgatcggggtagccatcccgcgcaacaactgggccgttacatgcgattccgcccagtcggggaatgaatgtaacaaggcaattgacggtaataaagacacgttttggcacactcaatatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgataccaaacacgacatgttttgccccggtatctcgatggacgggaatggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgcgacgaaccactttgatgcgcaaatctttacgccgaattatctttacgatagcaacgggaacttagccactcgccctaaaatcacccgcacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1278 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVKVGGWITISTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1279 - DNA, 1953 bp, Artificial Sequence
  Variant of Galactose Ox
atggcatcagcaccgatcggggtagccatcccgcgcaacaactgggccgttacatgcgattccgcccagtcggggaatgaatgtaacaaggcaattgacggtaataaagacacgttttggcacactgagtatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgataccaaacacgacatgttttgccccggtatctcgatggacggggatggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgtcgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacgacgaaccactttgatgcgcaaatctttacgccgaattatctttacgatagcaatgggaacttagccactcgccctaaaatcacccgcacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1280 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1281 - DNA, 1953 bp, Artificial Sequence
  Variant of Galactose Ox
atggcatcagcaccgatcggggtagccatcccgcgcaacaactgggccgttacatgcgattccgcccagtcggggaatgaatgtaacaaggcaattgacggtaataaagacacgttttggcacactcagtatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgataccaaacacgacatgttttgccccggtatctcgatggacggggatggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1282 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGDGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1283 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcagtatggtgtaaacggagatcccaaaccgccgcacaccatcacgatcgatatgaaaacagtccaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggatggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggcacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1284 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVKVGGWITISTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1285 - DNA, 1953 bp, Artificial Sequence
  Variant of Galactose Ox
atggcatcagcaccgatcggggtagccatcccgcgcaacaactgggccgttacatgcgattccgcccagtcggggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggatggtcagatcgtggtcagcggtggtaatgatgcaaagaaaacttccttatatgattcgagcctggactcttggattccgggctcggatatgcaggtcgcgcgtgggtatcaatcaagtgcgactctgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacgacgaaccactttgatgcgcaaatctttacgccgaattatctttacgatagcaacgggaacttagccactcgccctaaaatcacccgcacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1286 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTVTKHDMFCPGISMDGDGQIVVSGGNDAKKTSLYDSSLDSWIPGSDMQVARGYQSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1287 - DNA, 1953 bp, Artificial Sequence
  Variant of Galactose Ox
atggcatcagcaccgatcggggtagccatcccgcgcaacaactgggccgttacatgcgattccgcccagccggggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgataccaaacacgacatgttttgccccggtatctcgatggacggggatggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgcgacgaaccactttgatgcgcaaatctttacgccgaattatctttacgatagcgatgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1288 - protein, 650 aa, Artificial Sequence
  Variant of Galactose Ox
MASAPIGVAIPRNNWAVTCDSAQPGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDAFEGSPGGITLTSSWDPSTGIVSDRTSTDTKHDMFCPGISMDGDGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSDGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1289 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagttcaaaacgtgaatggcctttctgtactgccacgtcaggatggcaatcagaatggatggatcggacgtcacgaggtgtatttaagttctgatgggacgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccagcggccgccgcaattgagccaacgagcggtcgtgtcttgatgtggagctcttatcgtcaggatcgctttgagggttcgcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcctggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgctgccgaatacggtatttgcgagcaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcaaggtcggcgggtggatcaccatttcaactgacatgtcaatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1290 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGTNWGSPVASGSWFADSTTKYSNFETRPARYVRLVAITEANGQPWTSIAEINVFQASSYTAPQPGLGRWGPTIDLPIVPAAAAIEPTSGRVLMWSSYRQDRFEGSPGGITLTSSWDPSTGIVSDRTSTVTKHDMFCPGISMDGNGQIVVSGGNDAKKTSLYDSSLDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTLPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVKVGGWITISTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1291 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1292 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVVVGGWITIWTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1293 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1294 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1295 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactctgagtgatgggcgcgtatttacgattggcggcagtttctccggcgagcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1296 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATLSDGRVFTIGGSFSGEQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1297 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1298 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1299 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactctgagtgatgggcgcgtatttacgattggcggcagtttctccggcgggcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacggacgagggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1300 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATLSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITRTSTQSVVVGGWITIWTDMSISAASLIRYGTATHTVNTDQRRIPLTLTDEGGNSYSFQVPSDSGVALPGYWMLFVMNSAGVPSVASTIRVTQGQTGHHHHHH

SEQ ID NO: 1301 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcgagcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1302 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGEQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1303 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccggtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1304 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITGTSTQSVVVGGWITIWTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1305 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcgggcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctacgaaccactttgatgcgcaaatctttacgccgaattatctttacgatagcaacgggaacttagccactcgccctaaaatcaccggtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacgagggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1306 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITGTSTQSVVVGGWITIWTDMSISAASLIRYGTATHTVNTDQRRIPLTLTNEGGNSYSFQVPSDSGVALPGYWMLFVMNSAGVPSVASTIRVTQGQTGHHHHHH

SEQ ID NO: 1307 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcgggcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1308 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSDGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1309 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactgagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1310 - protein, 650 aa, Artificial Sequence
  Variant of Galactose Ox
MASAPIGVAIPRNNWAVTCDSAQSGNECNKAIDGNKDTFWHTEYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1311 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcagtatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacggggacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcgggcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgctacgaaccactttgatgcgcaaatctttacgccgaattatctttacgatagcgatgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacggacaatggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1312 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGDGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCATNHFDAQIFTPNYLYDSDGNLATRPKITRTSTQSVVVGGWITIWTDMSISAASLIRYGTATHTVNTDQRRIPLTLTDNGGNSYSFQVPSDSGVALPGYWMLFVMNSAGVPSVASTIRVTQGQTGHHHHHH

SEQ ID NO: 1313 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccccgccgccgcactggatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattcccagacaaagtactctaattttgagacacgtccggcccgttacgtgcgccttgtcgccattaccgaagccaatgggcaaccgtggacttcaattgccgagattaacgtatttcaggcgccgagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttattagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatacgttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccattgacactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1314 - protein, 650 aa, Artificial Sequence
  Variant of Galactose Ox
MASAPIGVAIPRNNWAVTCDSAQSGNECNKAIDGNKDTFWHTQYGVNGDPPPPHWITIDMKTVQNVNGLSVLPRQDGNQNGWIGRHEVYLSSDGVNWGSPVASGSWFADSQTKYSNFETRPARYVRLVAITEANGQPWTSIAEINVFQAPSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVISAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIDTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1315 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttattagtgcaggggatcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccattgacactgacatgtcgatctcggccgcaagtttaattcgctacggaactgctactcacacggtgaacaccgatcagcgccgcatcccgttgcagttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1316 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVISAGDRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIDTDMSISAASLIRYGTATHTVNTDQRRIPLQLTNNGGNSYSFQVPSDSGVALPGYWMLFVMNSAGVPSVASTIRVTQGQTGHHHHHH

SEQ ID NO: 1317 - DNA, 1953 bp, Artificial Sequence
  Variant of Galactose Ox
atggcatcagcaccgatcggggtagccatcccgcgcaacaactgggccgttaagtgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggaaaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacgcggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccgacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcatgcgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1318 - protein, 650 aa, Artificial Sequence
  Variant of Galactose Ox
MASAPIGVAIPRNNWAVKCDSAQSGNECNKAIDGNKDTFWHTQYGVNGDPKPPHTITIDMKTVQNVNGLSVLPRQDGNQNGWIGRHEVYLSSDGENWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKRGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKIMRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1319 - DNA, 1953 bp, Artificial Sequence
  Variant of Galactose Ox
atggcatcagcaccgatcggggtagccatcccgcgcaacaactgggccgttacgtgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggaaaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggtagccctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacgcggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccgacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcatgcgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1320 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGENWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKRGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKIMRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1321 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagccatgactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1322 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSHDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1323 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgtttagccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1324 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFSPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1325 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcaggggctcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1326 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGARQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1327 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcaagggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1328 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVKGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1329 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaggaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1330 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWRKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1331 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgaagattcgtgttacccagggccaaactggccaccatcaccatcaccattag

SEQ ID NO: 1332 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASKIRVTQGQTGHHHHHH

SEQ ID NO: 1333 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaagacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagataacacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1334 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDNTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1335 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacatgtttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1336 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYMFQVPSDSGVALPGYWMLFVMNSAGVPSVASTIRVTQGQTGHHHHHH

SEQ ID NO: 1337 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcaccgagacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1338 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITETSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1339 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1340 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIRVTQGQTGHHHHHH

SEQ ID NO: 1341 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggccgcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1342 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGPRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1343 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggagtaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1344 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1345 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtgtgtccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1346 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSVSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1347 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataatgacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1348 - protein, 650 aa, Artificial Sequence
  Variant of Galactose Ox
MASAPIGVAIPRNNWAVTCDSAQSGNECNKAIDGNNDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1349 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcttggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggactacgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacgaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1350 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTTLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1351 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttctggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtgatgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1352 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGDVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1353 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccggtcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1354 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1355 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtaatacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1356 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCNTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1357 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatggggggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1358 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMGGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1359 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatggaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1360 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMETVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1361 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacatgatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1362 - protein, 650 aa, Artificial Sequence
  Variant of Galactose Ox
MASAPIGVAIPRNNWAVTCDSAQSGNECNKAIDGNKDTFWHTQYGVNGDPKPPHMITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1363 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatcaaggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1364 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSIKAASLIRYGTATHTVNTDQRRIPLTLTNNGGNSYSFQVPSDSGVALPGYWMLFVMNSAGVPSVASTIRVTQGQTGHHHHHH

SEQ ID NO: 1365 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1366 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1367 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccattaagactgacatgtcgatctcggccgcaagtttaattcgctacggaactgctactcacacggtgaacaccgatcagcgccgcatcccgttgacgttaacgaacaacggaggtaattcgtacggttttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1368 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIKTDMSISAASLIRYGTATHTVNTDQRRIPLTLTNNGGNSYGFQVPSDSGVALPGYWMLFVMNSAGVPSVASTIRVTQGQTGHHHHHH

SEQ ID NO: 1369 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaatgttacccagggccaaactggccaccatcaccatcaccattag

SEQ ID NO: 1370 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1371 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtacggttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1372 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1373 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacatcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1374 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1375 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacgggtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1376 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDGSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1377 - DNA, 1953 bp, Artificial Sequence
  Variant of Galactose Ox
atggcatcagcaccgatcggggtagccatcccgcgcaacaactgggccgttacatgcgattccgcccagagtgggaatgaatcgaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1378 - protein, 650 aa, Artificial Sequence
  Variant of Galactose Ox
MASAPIGVAIPRNNWAVTCDSAQSGNESNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1379 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgatttgggttacccagggccaaactggccaccatcaccatcaccattag

SEQ ID NO: 1380 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIWVTQGQTGHHHHHH

SEQ ID NO: 1381 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactttttatggtgcaaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatgtgcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1382 - protein, 650 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYVQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1383 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaagccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcctcctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1384 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATPPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1385 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaatcgggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1386 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKSGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1387 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgtactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1388 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1389 - DNA, 1953 bp, Artificial Sequence
  Variant of Galactose Ox
atggcatcagcaccgatcggggtagccatcccgcgcaacaactgggccgttacatgcgattccgcccagagtgggaatgaacctaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1390 - protein, 650 aa, Artificial Sequence
  Variant of Galactose Ox
MASAPIGVAIPRNNWAVTCDSAQSGNEPNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1391 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcttgggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1392 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVLGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1393 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatacttttttaaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1394 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFLKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1395 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatagggcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1396 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNRAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1397 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgtgtttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1398 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLCLTNNGGNSYSFQVPSDSGVALPGYWMLFVMNSAGVPSVASTIRVTQGQTGHHHHHH

SEQ ID NO: 1399 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaactggtttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1400 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTGLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1401 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggtcgccctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcagactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1402 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGRPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1403 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttagggaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1404 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLGNNGGNSYSFQVPSDSGVALPGYWMLFVMNSAGVPSVASTIRVTQGQTGHHHHHH

SEQ ID NO: 1405 - DNA, 1953 bp, Artificial Sequence; identical to SEQ ID NO: 1389
  Variant of Galactose Ox

SEQ ID NO: 1406 - protein, 650 aa, Artificial Sequence; identical to SEQ ID NO: 1390
  Variant of Galactose Ox

SEQ ID NO: 1407 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1408 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1409 - DNA, 1953 bp, Artificial Sequence
  Variant of Galactose Ox
atggcatcagcaccgatcggggtagccatcccgcgcaacaactgggccgttacatgcgattccgcccagagtgggaatgaacctaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatcagtgccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1410 - protein, 650 aa, Artificial Sequence
  Variant of Galactose Ox
MASAPIGVAIPRNNWAVTCDSAQSGNEPNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1411 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggcccgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatcagtgccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1412 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGPPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1413 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacgacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatcagtgccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1414 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1415 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1416 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1417 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatggaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaagtggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1418 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMETVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKSGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1419 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaagtggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtacgacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1420 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKSGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1421 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaaaggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatcagtgccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1422 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1423 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaagtggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1424 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKSGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1425 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgatttgggttacccagggccaaactggccaccatcaccatcaccattag

SEQ ID NO: 1426 - protein, 650 aa, Artificial Sequence; identical to SEQ ID NO: 1380
  Variant of Galactose Ox

SEQ ID NO: 1427 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacacgatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtactgttgagaagaacggggaggtttactccccgagctcgaagacttggacttctctgccgaatgcaaaagttaaccccatgctgaccgccgataaacagggtctgtaccgtagcgataatcatgcttggctgtttgggtggtcgaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1428 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIRVTQGQTGHHHHHH

SEQ ID NO: 1429 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgtgtttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1430 - protein, 650 aa, Artificial Sequence; identical to SEQ ID NO: 1398
  Variant of Galactose Ox

SEQ ID NO: 1431 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1432 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIRVTQGQTGHHHHHH

SEQ ID NO: 1433 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacacgatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggtcgaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1434 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIRVTQGQTGHHHHHH

SEQ ID NO: 1435 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggtcgaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgtgtttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1436 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLCLTNNGGNSYSFQVPSDSGVALPGYWMLFVMNSAGVPSVASTIRVTQGQTGHHHHHH

SEQ ID NO: 1437 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgatttgggttacccagggccaaactggccaccatcaccatcaccattag

SEQ ID NO: 1438 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIWVTQGQTGHHHHHH

SEQ ID NO: 1439 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgtgtttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1440 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLCLTNNGGNSYSFQVPSDSGVALPGYWMLFVMNSAGVPSVASTIRVTQGQTGHHHHHH

SEQ ID NO: 1441 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatggcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgatttgggttacccagggccaaactggccaccatcaccatcaccattag

SEQ ID NO: 1442 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMAISAASLIRYGTATHTVNTDQRRIPLTLTNNGGNSYSFQVPSDSGVALPGYWMLFVMNSAGVPSVASTIWVTQGQTGHHHHHH

SEQ ID NO: 1443 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttctctgccgaatgcaaaagttaaccccatgctgaccgccgataaacagggtctgtaccgtagcgataatcatgcttggctgtttgggtggtcgaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagttttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1444 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1445 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtactgttgagaagaacggggaggtttactccccgagctcgaagacttggacttctctgccgaatgcaaaagttaaccccatgctgaccgccgataaacagggtctgtaccgtagcgataatcatgcttggctgtttgggtggtcgaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1446 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWSKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1447 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcaccgtatcacgatcgatatgaaaacagtacaaaacgtgaatggcctttctgtactgccacgtcaggatggcaatcagaatggatggatcggacgtcacgaggtgtatttaagttctgatggggtgaattggggaagccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccaaacacgacatgttttgccccggtatctcgatggacgggaacggtcagatcgtggtcagcggtggtaatgatgcaaagaaaacttccttatatgattcgagcagtgactcttggattccgggcccggatatgcaggtcgcgcgtgggtatcaatcaagtgcgactatgagtgatgggcgcgtatttacgattggcggcagtttctccggcggtactgttgagaagaacggggaggtttactccccgagctcgaagacttggacttctctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtactacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgaccttaacgaacaacggaggtaattcgtacagctttcaagttccgtcggacagcggggttgctcttccgggatactggatgttgttcgttatgaattccgctggtgtaccctccgttgcgtcgacgattcgtgttacccagggccaaactggccaccatcaccatcaccattag

SEQ ID NO: 1448 - protein, 650 aa, Artificial Sequence
  Variant of Galactose Ox
MASAPIGVAIPRNNWAVTCDSAQSGNECNKAIDGNKDTFWHTQYGVNGDPKPPHRITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTKHDMFCPGISMDGNGQIVVSGGNDAKKTSLYDSSSDSWIPGPDMQVARGYQSSATMSDGRVFTIGGSFSGGTVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCTTNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTIRVTQGQTGHHHHHH

SEQ ID NO: 1449 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatggttcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1450 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1451 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgggcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1452 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFGRTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1453 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttattgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1454 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1455 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1456 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1457 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccggtgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1458 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPVPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1459 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatgtggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1460 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNVVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1461 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1462 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1463 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1464 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1465 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatccgtggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1466 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHPWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1467 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcattgcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1468 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSLRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1469 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagccttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1470 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSLQVPSDSGVALPGYWMLFVMNSAGVPSVASTINVTQGQTGHHHHHH

SEQ ID NO: 1471 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtgataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1472 - protein, 650 aa, Artificial Sequence
  Variant of Galactose Ox
MASAPIGVAIPRNNWAVTCDSAQSGNECNKAIDGDKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1473 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccgtttatgattcgagctcggactcttggattccgggcccggatatgcaggtcgcgcgtgggtatcaatcaagtgcgactatgagtgatgggcgcgtatttacgattggcggcagtttctccggcggtcaagttgagaaaaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1474 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSVYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1475 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcaactaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1476 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDATKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1477 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggtctaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1478 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWSTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1479 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaactgccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1480 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQLPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1481 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgatatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1482 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTDMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1483 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgcgggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1484 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPAGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1485 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggcgttggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1486 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGRWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1487 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacctgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1488 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYLPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1489 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccaggggtgtaccctccgttgcgtcgacgattaacgttacccagggccaaactggccaccatcaccatcaccattag

SEQ ID NO: 1490 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSRGVPSVASTINVTQGQTGHHHHHH

SEQ ID NO: 1491 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatgttgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1492 - protein, 650 aa, Artificial Sequence
  Variant of Galactose Ox
MASAPIGVAIPRNNWAVTCDSAQSGNECNKAIDGNKDTFWHTQYVVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1493 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgaagatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1494 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMKISAASLIRYGTATHTVNTDQRRIPLTLTNNGGNSYSFQVPSDSGVALPGYWMLFVMNSAGVPSVASTINVTQGQTGHHHHHH

SEQ ID NO: 1495 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcaggtaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1496 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAGKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1497 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccatgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1498 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAHDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1499 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactcatccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1500 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTHPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1501 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1502 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1503 - DNA, 1953 bp, Artificial Sequence
  Variant of Galactose Ox
atggcatcagcaccgatcggggtagccatcccgcgccataactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1504 - protein, 650 aa, Artificial Sequence
  Variant of Galactose Ox
MASAPIGVAIPRHNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1505 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtatgatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1506 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGMIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1507 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgtggacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1508 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTWTNNGGNSYSFQVPSDSGVALPGYWMLFVMNSAGVPSVASTINVTQGQTGHHHHHH

SEQ ID NO: 1509 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgggggcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1510 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1511 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattttacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1512 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYFTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1513 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagaagctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1514 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQKLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1515 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1516 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1517 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagataaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1518 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDADKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1519 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacacgaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1520 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDTKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1521 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1522 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1523 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacggttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1524 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1525 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1526 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1527 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcattgtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1528 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIIVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1529 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcacctaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1530 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAPKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1531 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccttgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1532 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVALDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1533 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaaatgacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1534 - protein, 650 aa, Artificial Sequence
  Variant of Galactose Ox
MASAPIGVAIPRNNWAVTCDSAQSGNECNKAIDGNKMTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1535 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaatatacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1536 - protein, 650 aa, Artificial Sequence
  Variant of Galactose Ox
MASAPIGVAIPRNNWAVTCDSAQSGNECNKAIDGNKYTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1537 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactacgatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1538 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTTMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1539 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacatgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1540 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYMPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1541 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattagtggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1542 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1543 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1544 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1545 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaaattacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1546 - protein, 650 aa, Artificial Sequence
  Variant of Galactose Ox
MASAPIGVAIPRNNWAVTCDSAQSGNECNKAIDGNKITFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1547 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcggttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1548 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1549 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatattcggctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1550 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYSARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1551 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggacgaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1552 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWTTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1553 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacagggccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1554 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNRATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1555 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagaggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1556 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQRLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1557 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttaggtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1558 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLGFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1559 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaccccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1560 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQTPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1561 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtagttcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1562 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRSSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1563 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1564 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1565 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagttgctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1566 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQLLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1567 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatcccctcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1568 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1569 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtatttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1570 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARIFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1571 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1572 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1573 - DNA, 1953 bp, Artificial Sequence
  Variant of Galactose Ox
atggcatcagcaccgatcggggtagccatcccgcgcgccaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccggttccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatgtagtatttgcgagtaatgggttagtcttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1574 - protein, 650 aa, Artificial Sequence
  Variant of Galactose Ox
MASAPIGVAIPRANWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPVPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNVVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1575 - DNA, 1953 bp, Artificial Sequence
  Variant of Galactose Ox
atggcatcagcaccgatcggggtagccatcccgcgcaataactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttgtatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtatttcacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1576 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYFTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1577 - DNA, 1953 bp, Artificial Sequence
  Variant of Galactose Ox
atggcatcagcaccgatcggggtagccatcccgcgcaataactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaacgcaaaagttaaccccatgctgaccgccgataaacagggtctgtaccgtagcgataatcatgcttggctgtttgggtggaaaaagggtagcgtcttccaagcaggtccaagtactgccatgaattggtattacacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggattaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1578 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1579 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaacgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtcttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgaagatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1580 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMKISAASLIRYGTATHTVNTDQRRIPLTLTNNGGNSYSFQVPSDSGVALPGYWMLFVMNSAGVPSVASTINVTQGQTGHHHHHH

SEQ ID NO: 1581 - DNA, 1953 bp, Artificial Sequence
  Variant of Galactose Ox
atggcatcagcaccgatcggggtagccatcccgcgcgccaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1582 - protein, 650 aa, Artificial Sequence
  Variant of Galactose Ox
MASAPIGVAIPRANWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1583 - DNA, 1953 bp, Artificial Sequence
  Variant of Galactose Ox
atggcatcagcaccgatcggggtagccatcccgcgcaataactgggccgttacatgcgattccgcccagagtgggatggaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1584 - protein, 650 aa, Artificial Sequence
  Variant of Galactose Ox
MASAPIGVAIPRNNWAVTCDSAQSGMECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYGSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1585 - DNA, 1953 bp, Artificial Sequence
  Variant of Galactose Ox
atggcatcagcaccgatcggggtagccatcccgcgcaataactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccggttccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatactgtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggattaccatttggactgacatgtcgatctcggccgcaagtttaattcgctacggaactgctactcacacggtgaacaccgatcagcgccgcatcccgttgacgttaacgaacaacggaggtaattcgtacagctttcaggttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1586 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPVPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1587 - DNA, 1953 bp, Artificial Sequence
  Variant of Galactose Ox
atggcatcagcaccgatcggggtagccatcccgcgcgccaactgggccgttacatgcgattccgcccagagtgggatggaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccggttccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaacgcaaaagttaaccccatgctgaccgccgataaacagggtctgtaccgtagcgataatcatgcttggctgtttgggtggaaaaagggtagcgtcttccaagcaggtccaagtactgccatgaattggtatttcacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatgtagtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggattaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1588 - protein, 650 aa, Artificial Sequence
  Variant of Galactose Ox
MASAPIGVAIPRANWAVTCDSAQSGMECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPVPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYFTSGSGDVKSAGKRQSNRGVAPDAMCGNAVMYDAVKGKILTFGGSPDYEDSDATTNAHIITLGEPGTSPNVVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1589 - DNA, 1953 bp, Artificial Sequence
  Variant of Galactose Ox
atggcatcagcaccgatcggggtagccatcccgcgcaataactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtgaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggattaccatttggactgacatgtcgatctcggccgcaagtttaattcgctacggaactgctactcacacggtgaacaccgatcagcgccgcatcccgttgacgttaacgaacaacggaggtaattcgtacagctttcaggttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1590 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYGSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1591 - DNA, 1953 bp, Artificial Sequence
  Variant of Galactose Ox
atggcatcagcaccgatcggggtagccatcccgcgcgccaactgggccgttacatgcgattccgcccagagtgggaacgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatactgtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1592 - protein, 650 aa, Artificial Sequence
  Variant of Galactose Ox
MASAPIGVAIPRANWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYGSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1593 - DNA, 1953 bp, Artificial Sequence
  Variant of Galactose Ox
atggcatcagcaccgatcggggtagccatcccgcgcgccaactgggccgttacatgcgattccgcccagagtgggaacgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgaacgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttaaaattcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggattaccatttggactgacatgaagatctcggccgcaagtttaattcgctacggaactgctactcacacggtgaacaccgatcagcgccgcatcccgttgacgttaacgaacaacggaggtaattcgtacagctttagcgttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1594 - protein, 650 aa, Artificial Sequence
  Variant of Galactose Ox
MASAPIGVAIPRANWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLKFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMKISAASLIRYGTATHTVNTDQRRIPLTLTNNGGNSYSFSVPSDSGVALPGYWMLFVMNSAGVPSVASTINVTQGQTGHHHHHH

SEQ ID NO: 1595 - DNA, 1953 bp, Artificial Sequence
  Variant of Galactose Ox
atggcatcagcaccgatcggggtagccatcccgcgcgccaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatgggtcaagtgcgactatgagtgatgggcgcgtatttacgattggcggcagtttctccggcggtcaagttgagaagaacggggaggtttactccccgagctcgaagacttggacttcgctgccgggtgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtcttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1596 - protein, 650 aa, Artificial Sequence
  Variant of Galactose Ox
MASAPIGVAIPRANWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYGSSATMSDGRVFTIGGSFSGGQVEKNGEVYSPSSKTWTSLPGAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1597 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1598 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1599 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgggggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgctgacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1600 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1601 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1602 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1603 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcagtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccctgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1604 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1605 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcagtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccctgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaaccgtgccactcgccctaaaatcacccgtacttcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1606 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNRATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1607 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacactatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgtggacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1608 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTWTNNGGNSYSFQVPSDSGVALPGYWMLFVMNSAGVPSVASTINVTQGQTGHHHHHH

SEQ ID NO: 1609 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccatgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacctggccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1610 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAHDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1611 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1612 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1613 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagcgcctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccctgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1614 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQRLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1615 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcagtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagttaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaaccgtgccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1616 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNRATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1617 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcagtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgtgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacctggccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgtggacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1618 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTWTNNGGNSYSFQVPSDSGVALPGYWMLFVMNSAGVPSVASTINVTQGQTGHHHHHH

SEQ ID NO: 1619 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcagtcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggcctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaactgccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1620 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQLPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1621 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1622 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1623 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgggggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacttcaacccagtcagtcgtggtcggcgggtggatcaccatttggactgacatgtcgatctcggccgcaagtttaattcgctacggaactgctactcacacggtgaacaccgatcagcgccgcatcccgttgacgtggacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1624 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTWTNNGGNSYSFQVPSDSGVALPGYWMLFVMNSAGVPSVASTINVTQGQTGHHHHHH

SEQ ID NO: 1625 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccatgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacctggccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1626 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAHDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1627 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgggggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccctgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggaccaaactggccaccatcaccatcaccattag

SEQ ID NO: 1628 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1629 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgggggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1630 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1631 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatgttgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggcctgtaccgtagcgataatcatgcttggctgtttgggtggaaaaagggtagcgtcttccaagcaggtccaagtactgccatgaattggtattatacatctgggtcgggggacgttaagagtgcagggaagcgtacttcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacttcaacccagtcagtcgtggtcggcgggtggatcaccatttggactgacatgtcgatctcggccgcaagtttaattcgctacggaactgctactcacacggtgaacaccgatcagcgccgcatcccgttgacgctgacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccatagg

SEQ ID NO: 1632 - protein, 651 aa, Artificial Sequence
  Variant of Galactose Ox
MASAPIGVAIPRNNWAVTCDSAQSGNECNKAIDGNKDTFWHTQYVVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRTSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHHR

SEQ ID NO: 1633 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagcccatgacgccatgtgcggtaatgccgtaatgtacgacgcagttaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacctggccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1634 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAHDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1635 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccaggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcaccaaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacttcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1636 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAPKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1637 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctgggggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggcctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagcccatgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacctggccactcgccctaaaatcacccgtacttcaacccagtcagtcgtggtcggcgggtggatcaccatttggactgacatgtcgatctcggccgcaagtttaattcgctacggaactgctactcacacggtgaacaccgatcagcgccgcatcccgttgacgctgacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1638 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAHDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1639 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggttccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1640 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1641 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggcctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaaccgtgccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgctgacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1642 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNRATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1643 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttacctggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1644 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTWHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1645 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1646 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1647 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccctggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1648 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVALDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1649 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccgcgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggctggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1650 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1651 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagctgctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1652 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQLLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1653 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactacgatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1654 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTTMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1655 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccccgcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgcgatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacatgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1656 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYMPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1657 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacatgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggctggaccaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1658 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYMPEQDTFYKQNPNSIVRAYHSISLLLPDGRVFNGGGGLCGDCETNHFDAQIFTPNYLYDSNGNLATRPKITRTSTQSVVVGGWTTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1659 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccccgcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccctggacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1660 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVALDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1661 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaaatgacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1662 - protein, 650 aa, Artificial Sequence
  Variant of Galactose Ox
MASAPIGVAIPRNNWAVTCDSAQSGNECNKAIDGNKMTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1663 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggctggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1664 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1665 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaatacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgcgatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagctggaccaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1666 - protein, 650 aa, Artificial Sequence
  Variant of Galactose Ox
MASAPIGVAIPRNNWAVTCDSAQSGNECNKAIDGNKYTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWTTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1667 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagtcacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgtgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1668 - protein, 650 aa, Artificial Sequence
  Variant of Galactose Ox
MASAPIGVAIPRNNWAVTCDSAQSGNECNKAIDGNKVTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1669 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactacgatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1670 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTTMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1671 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccccgcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgtgcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggctggaccaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1672 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWTTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1673 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccccgcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactacgatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1674 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTTMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1675 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagctggaccaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1676 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWTTIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1677 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtatttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1678 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARIFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1679 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtatttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagcatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1680 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARIFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1681 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaaatgacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1682 - protein, 650 aa, Artificial Sequence
  Variant of Galactose Ox
MASAPIGVAIPRNNWAVTCDSAQSGNECNKAIDGNKMTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1683 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1684 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1685 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccccgcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1686 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSPRTSTVTGHDMFCPGISMDGNGQIVVSGGNDAKKTSLYDSSSDSWIPGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1687 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtacttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactacgatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagctggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1688 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYQSSATMSDGRVFTIGGSFSGGQVEKNGEVYSPSSKTWTSLPNAKVNPMLTADKQGLYRSDNHAWLFGWKKGSVFQAGPSTTMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1689 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacttttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagctggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1690 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1691 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtatcaatcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagctggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1692 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYQSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1693 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1694 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1695 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgcgcttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1696 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVRLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1697 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatttcgggcccggatatgcaggtcgcgcgtgggtataattcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacaggggctgtaccgtagcgataatcatgcttggctgtttgggtggaaaaagggtagcgtcttccaagcaggtccaagtactgccatgaattggtattatacatctgggtcgggggacgttaagagtgcagggaagcgtcagtcaaatcgcggagtagcccgcgacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatatttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1698 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVARDAMCGNAVMYDAVKGKILTFGGSPDYEDSDATTNAHIITLGEPGTSPNTVFASNGLYFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1699 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacactcgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1700 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTLVFTPEIYVPEQDTFYKQNPNSIVRAYHSISLLLPDGRVFNGGGGLCGDCETNHFDAQIFTPNYLYDSNGNLATRPKITRTSTQSVVVGSWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1701 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1702 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1703 - DNA, 1953 bp, Artificial Sequence
  Variant of Galactose Ox
atggcatcagcaccgatcggggtagccatcccgcgcaacaactgggccgttacatgcgattccgcccagagtgggaatgaatgtaacaaggcaattgacggtaataaagacacgttttggcacactttttatggtgccaacggagatcccaaaccgccgcacacctatacgatcgatatgaaaacaacgcaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggcccgcccgattatgaggattcagacgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1704 - protein, 650 aa, Artificial Sequence
  Variant of Galactose Ox
MASAPIGVAIPRNNWAVTCDSAQSGNECNKAIDGNKDTFWHTFYGANGDPKPPHTYTIDMKTTQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGPPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1705 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1706 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1707 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1708 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1709 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1710 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1711 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1712 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1713 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1714 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1715 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1716 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1717 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1718 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1719 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1720 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1721 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1722 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1723 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1724 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1725 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1726 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1727 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctggttcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgactattaacgttacccaggatcaaactggccaccatcaccatcaccattag

SEQ ID NO: 1728 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1729 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1730 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1731 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1732 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1733 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1734 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1735 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1736 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1737 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1738 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1739 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1740 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1741 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1742 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1743 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1744 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1745 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1746 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1747 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1748 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1749 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagatcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1750 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSRSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1751 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1752 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITAWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1753 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctctgttgcgtcgacgattaacgttacccagggtcaaactggccaccatcaccatcaccattag

SEQ ID NO: 1754 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1755 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1756 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1757 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccaggatcaaactggccaccatcaccatcaccattag

SEQ ID NO: 1758 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITAWTDMSISAASLIRYGTATHTVNTDQRRIPLTLTNNGGNSYSFQVPSDSGVALPGYWMLFVMNSAGVPSVASTINVTQDQTGHHHHHH

SEQ ID NO: 1759 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1760 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1761 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1762 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1763 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1764 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1765 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttacgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1766 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLRFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1767 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1768 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1769 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgtggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1770 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1771 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1772 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1773 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttatgtttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1774 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLCFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1775 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1776 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1777 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccgcctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1778 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITAWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1779 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1780 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1781 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagacgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1782 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1783 - DNA, 1953 bp, Artificial Sequence
  Variant of Galactose Ox
atggcatcagcaccgatcggggtagccatcccgcgcaagaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggatctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1784 - protein, 650 aa, Artificial Sequence
  Variant of Galactose Ox
MASAPIGVAIPRKNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWISGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1785 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtctcgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcagttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggtcaaactggccaccatcaccatcaccattag

SEQ ID NO: 1786 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVSGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAKDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGSWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1787 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggacaccctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgctgccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttagtgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcggttggatcaccatctggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1788 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGHPVASGSWFADSTTKYSNFETRPARYVRLVAITEANGQPWTSIAEINVFQASSYTAPLPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWIPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLVFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1789 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttgggtcccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccccagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

SEQ ID NO: 1790 - protein, 650 aa, Artificial Sequence
  Variant of Galactose Ox
MASAPIGVAIPRNNWAVTCDSAQSGNECNKAIDGNKDTFWHTQYGVNGDPKPPHTITIDMKTVQNVNGLSVLPRQDGNQNGWIGRHEVYLSSDGVNWGSPVASGSWFADSTTKYSNFETRPARYVRLVAITEANGQPWTSIAEINVFQASSYTAPQPGLGRWGPTIDLPIVPSAAAIEPTSGRVLMWSSYRQDAFEGSPGGITLTSSWDPSTGIVSDRTSTVTGHDMFCPGISMDGNGQIVVSGGNDAKKTSLYDSSSDSWVPGPDMQVARGYNSSATMSDGRVFTIGGSFSGGQVEKNGEVYSPSSKTWTSLPNAKVNPMLTADKQGLYRSDNHAWLFGWKKGSVFQAGPSTAMNWYYTSGSGDVKSAGKRQSNRGVAPDAMCGNAVMYDAVKGKILTFGGSPDYEDSDATTNAHIITLGEPGTSPNTVFASNGLLFARTFHTSVVLPDGSTFITGGQQRGIPTEDSTPVFTPEIYVPEQDTFYKQNPNSIVRAYHSISLLLPDGRVFNGGGGLCGDCETNHFDAQIFTPNYLYDSNGNLATRPKITRTSTQSVVVGGWITIWTDMSISAASLIRYGTATHTVNTDQRRIPLTLTNNGGNSYSFQVPSDSGVALPGYWMLFVMNSAGVPSVASTINVTQGQTGHHHHHH

SEQ ID NO: 1791 - DNA, 1953 bp, Artificial Sequence
  Variant of Galactose Ox
atggcatcagcaccgatcggggtagccatcccgcgcaacaactgggccgttacatgcgattccgcccagagtgggaatgaatgcaacaaggcaattgacggtaataaagacacgttttggcacactcaatatggtgtaaacggagatcccaaaccgccgcacaccatcacgatcgatatgaaaacagtacaaaacgtgaatggcctttctgtactgccacgtcaggatggcaatcagaatggatggatcggacgtcacgaggtgtatttaagttctgatggggtgaattggggatcgcctgtagcgtctgggtcctggtttgccgattccaccacaaagtactctaattttgagacacgtccggcccgttacgtgcgccttgtcgccattaccgaagccaatgggcaaccgtggacttcaattgccgagattaacgtatttcaggcgtctagttacactgccccgcagccgggcttggggcgctggggcccgacaatcgatcttcccattgtgccatcggccgccgcaattgagccaacgagcggtcgtgtcttgatgtggagctcttatcgtcaggatgcgtttgagggttctcctggcggtattacactgacgagctcatgggaccctagcactggaattgtatccgatcgcactagtaccgttaccgggcacgacatgttttgccccggtatctcgatggacgggaacggtcagatcgtggtcagcggtggtaatgatgcaaagaaaacttccttatatgattcgagctcggactcttggattccgggcccggatatgcaggtcgcgcgtgggtataactcaagtgcgactatgagtgatgggcgcgtatttacgattggcggcagtttctccggcggtcaagttgagaagaacggggaggtttactccccgagctcgaagacttggacttcgctgccgaatgcaaaagttaaccccatgctgaccgccgataaacagggtctgtaccgtagcgataatcatgcttggctgtttgggtggaaaaagggtagcgtcttccaagcaggtccaagtactgccatgaattggtattatacatctgggtcgggggacgttaagagtgcagggaagcgtcaatcaaatcgcggagtagccaaagacgccatgtgcggtaatgccgtaatgtacgacgcagtcaaaggcaaaattttgactttcgggggctcgcccgattatgaggattcagatgcgactacaaatgcccatattatcacgctgggcgagcctggcacgagtccgaatacggtatttgcgagtaatgggttactgttcgctcgtacctttcatacctcggtggtccttccggacgggagtaccttcatcacaggaggccagcagcgcggaatcccaacggaagatagcacacccgtatttactccagagatctacgttcccgaacaagatactttttacaaacaaaacccgaatagtatcgttcgtgcctatcattccatcagcttgttgctgccggacggacgtgttttcaatggtggcggtggcttatgcggcgattgtgagacgaaccactttgatgcgcaaatctttacgccgaattatctttacgatagcaacgggaacttagccactcgccctaaaatcacccgtacctcaacccagtcagtcgtggtcggcgggtggatcaccatttggactgacatgtcgatctcggccgcaagtttaattcgctacggaactgctactcacacggtgaacaccgatcagcgccgcatcccgttgacgttaacgaacaacggaggtaattcgtacagctttcaagttccgtcggacagcggggttgctcttccgggatactggatgttgttcgttatgaattccgctggtgtaccctccgttgcgtcgacgattaacgttacccagggccaaactggccaccatcaccatcaccattag

(The sequence listing continues in the following parts.)

We claim:

1. An engineered galactose oxidase comprising a polypeptide sequence having at least 95%, sequence identity to SEQ ID NO: 2, or a functional fragment thereof, wherein said engineered galactose oxidase comprises substitutions in said polypeptide sequence at positions 331, 406, and 465, and wherein said engineered galactose oxidase does not comprise substitutions at positions 11 and 71, and wherein the amino acid positions of said polypeptide sequence are numbered with reference to SEQ ID NO: 2, and wherein said engineered galactose oxidase comprises production of 2-ethynylglyceraldehyde with increased enantiomeric excess of the R-stereoisomer as compared to wild-type *F. graminearium* galactose oxidase.

2. The engineered galactose oxidase of claim 1, wherein said engineered galactose oxidase further comprises at least one substitution or substitution set at one or more positions in said polypeptide sequence selected from 170, 171, 173, 191, 192, 193, 194, 197, 198, 199, 202, 204, 205, 220, 227, 243, 247, 248, 252, 269, 294, 296, 324, 332, 407, 463, 466, 493, 515, 517, 520, 521, and 522, wherein the amino acid positions of said polypeptide sequence are numbered with reference to SEQ ID NO: 2.

3. The engineered galactose oxidase of claim 1, wherein said engineered galactose oxidase further comprises at least one substitution or substitution set at one or more positions in said polypeptide sequence selected from 171, 173, 188, 192, 197, 199, 203, 220, 223, 243, 252, 294, 295, 296, 332, 407, 466, 493, 515, 517, 520, and 521, wherein the amino acid positions of said polypeptide sequence are numbered with reference to SEQ ID NO: 2.

4. The engineered galactose oxidase of claim 1, wherein said engineered galactose oxidase further comprises at least one substitution or substitution set at one or more positions in said polypeptide sequence selected from 171/220/295/296/407, 171/220/296/407/520, 171/220/332/407, 171/220/407, 171/243/296/332, 171/295/332, 171/296/407, 171/332, 171/407, 171/407/520, 173, 192/220/295/296/332/521, 192/220/295/520/521, 192/220/296/332/520, 192/220/407, 192/295/296, 192/295/296/332, 192/295/296/520/521, 192/296, 198/294/296, 198/295, 198/295/296, 204, 220, 220/243, 220/243/295/296/332/407/521, 220/243/295/296/407, 220/243/407, 220/243/407/520/521, 220/252/332/407, 220/295/296, 220/295/296/332, 220/295/296/332/407/520, 220/295/296/332/407/521, 220/295/296/407, 220/295/407/520/521, 220/295/407/521, 220/296, 220/296/332/407, 220/296/332/407/520/521, 220/296/407, 220/407, 220/407/520, 227, 243/295, 243/295/407, 243/515/517, 277/296/407/520/521, 284/295/296, 294/296/407 294/521, 295/296, 295/296/332/407, 295/296/407, 295/296/407/521, 295/296/521, 295/332/407/521, 295/332/520/521, 295/407, 296, 296/332/407/520, 296/332/407/521, 296/407, 296/520/521, 332/407, 332/407/520/521, 332/407/521, 407, 407/520, and 517, wherein the amino acid positions of said polypeptide sequence are numbered with reference to SEQ ID NO: 2.

5. The engineered galactose oxidase of claim 1, wherein said engineered galactose oxidase further comprises at least one substitution or substitution set at one or more positions in said polypeptide sequence selected from 4, 8, 8/29/92/196/258/426, 8/46/92/279/296/426/549/553/597, 8/56/192/194/460/571/598, 8/56/243/560/598, 8/92/258/363/549/553/567, 8/192/194/243/460/553/560, 8/192/460/560/598, 8/258/363/426/553/597, 16, 16/24/43/56/103/220/295/296/499/549, 16/43/56/103/148/220/295/296/499/549, 16/43/63/103/295/304/499/549, 16/43/63/148/295/499, 16/43/103/148/220/295/426/549, 16/43/148/220/295/499, 16/43/295/296/549, 16/43/426/549, 16/56/63/148/295/296/304/426, 16/56/296, 16/56/426/499, 16/63/103/220/295/426/549, 16/148/220/295/296/304/499, 16/148/220/295/426/499/549, 16/148/220/296/549, 16/148/295/426/549, 16/220/499, 16/295/296/426/499/549, 24, 24/36, 24/36/43/148/319/560/637, 24/36/92/148, 24/36/92/222/560/637, 24/36/92/279/319/363/637, 24/36/148/222/279/560/637, 24/43/92/279/363/560/637, 24/43/92/279/499, 24/43/148/295/560, 24/43/148/363, 24/43/148/560, 24/43/222, 24/92/148/279/363, 24/148/637, 24/637, 29, 29/46/92/196/258/279/363/426/481/567/597, 36, 36/43/92/148/222/279/295/499/560/637, 36/92/148/279/319/363/560/637, 36/92/148/499/637, 36/92/319/363/637, 36/92/560, 36/222/279/319/363/560, 43, 43/56/220/296/426/499/549, 43/56/220/426/549, 43/92/148/222/279/499/560, 43/148/279/295/560, 43/148/549, 43/222/279, 43/295/499, 46, 56, 63, 92, 103, 134, 148, 192/243, 194, 196, 220/295/520, 220/295/521, 220/296/304/426/549, 222, 257, 258, 279, 279/560/637, 295, 296, 304, 319, 363, 363/426/481/553, 426, 499, 549, 553, 560, 567, 597, and 637, wherein the amino acid positions of said polypeptide sequence are numbered with reference to SEQ ID NO: 2.

6. The engineered galactose oxidase of claim 1, wherein said engineered galactose oxidase further comprises at least one substitution or substitution set at one or more positions in said polypeptide sequence selected from 4/8/56/598, 4/56/192/194/257/571/598, 4/56/194/329/598, 4/194/243/549/598, 8/29/46/196/363/481/549/553, 8/56, 8/56/192/194/243/329, 8/56/192/194/243/329/460/560, 8/56/192/194/243/460/560/598, 8/56/192/243/460, 8/56/192/243/598, 8/56/194/257/460/549/560/598, 8/92/196/258/426/597, 8/92/196/481/597, 8/192/194/243/329/460/560, 8/196/258/

279/481/549/553, 8/243/460/560/571/598, 8/257/460/560/ 598, 8/258/363/426/549, 8/279/363/426/481/549/553, 16/43/63/103/295/296/499, 16/43/103/148/295/426/499/ 549, 16/43/103/304/499/549, 16/43/148/295/296/304/499/ 549, 16/43/148/296/426/499, 16/43/295/296/499, 16/56/ 103/220/295, 16/56/103/220/295/296, 16/56/103/295/549, 16/56/148/295/296/304/426/549, 16/56/220/295, 16/56/ 220/499/549, 16/56/295, 16/56/295/296/549, 16/56/295/ 499, 16/56/499/549, 16/63/103/148/426/499/549, 16/63/ 103/426/499/549, 16/63/148/220/295/296/426/499, 16/63/ 148/499/549, 16/103, 16/103/148, 16/103/148/220/499, 16/103/148/295/426/499/549, 16/103/220/295, 16/148/220/ 295/426/499, 16/148/295/426, 16/148/295/549, 16/148/426/ 549, 16/220/295/296, 16/304/426/499, 16/304/499/549, 24/36/92/279/295/363/499, 24/43/92/148/279/295/319/637, 24/43/92/222/279, 24/43/222/319, 24/43/363/637, 24/92, 24/92/148/279, 24/92/222/279/319/637, 24/222/637, 24/279/319, 29/46/92/196/426/481/549/597, 29/46/481/ 549/553/597, 29/426/549, 29/549/553, 36/43/222/279/363/ 560, 36/92/148/222/279/319/363/499/560/637, 36/92/222/ 637, 36/148/279/319/499, 43/148/222/279/560/637, 43/220/ 295/549, 56/148/220/295/499, 56/194/243/257/329/460, 56/243, 63/103/148/220/295/549, 63/220/295/304/426/499/ 549, 63/220/295/304/549, 92, 92/222/279/499/560/637, 92/258/363/426/481/549/597, 103/295/499/549, 148/220/ 304, 148/222, 148/222/560/637, 148/279/319/499, 194/243/ 329/460, 194/243/329/560/571/598, 220/295/549, 279/296/ 481/549/553/567/597, 279/560/637, 295/296/426/549, 295/ 296/549, 295/499/560/637, 296/363/426/481/549, 319/560, 319/637, and 363/560, wherein the amino acid positions of said polypeptide sequence are numbered with reference to SEQ ID NO: 2.

7. The engineered galactose oxidase of claim 1, wherein said engineered galactose oxidase further comprises at least one substitution or substitution set at one or more positions in said polypeptide sequence selected from 4/43/46/56/63/ 279/295/319/567/598, 4/43/46/295/319/549/560, 4/43/46/ 426/549/560, 4/43/148/196/279/319/363/560, 16, 16/24/29, 16/24/29/92/220/279/597/598, 16/24/29/279/549, 16/24/29/ 279/637, 16/24/43/92/549, 16/24/43/192/220/279/549, 16/29/36/192/319/549/597/598/637, 16/29/36/279/549, 16/29/43/92/192/319, 16/29/43/192/222/319/549/637, 16/29/43/222/279/549, 16/29/92/192/549/637, 16/29/92/ 220/222/319/549/598, 16/29/92/279/549, 16/29/92/319/549, 16/29/92/549/637, 16/29/192/220/549, 16/29/192/220/549/ 597, 16/29/192/222/279/549, 16/29/192/222/637, 16/29/ 192/549, 16/29/220/222/279/549/637, 16/29/220/222/597/ 598, 16/29/222/549/598/637, 16/29/549/637, 16/36/43/192/ 597/637, 16/36/92/220/222/279/549, 16/36/192/549/597/ 598/637, 16/36/319/549/597/598/637, 16/43/56/192/549/ 597/598/637, 16/43/92/222/597/598, 16/43/192/549, 16/43/ 220/549/637, 16/43/279/319/597, 16/43/279/549/597, 16/43/319/549/598, 16/43/597, 16/92/192/279/319/549/637, 16/92/192/279/637, 16/92/220/549, 16/92/319/597/637, 16/192/319/549/637, 16/192/549, 16/220/222/279/549/598/ 637, 16/220/279/549, 16/220/319/549/597/598, 16/222/319/ 597/598, 16/222/637, 16/279/319/549/597/637, 16/279/549/ 597/598/637, 16/279/597, 16/319/597, 16/319/597/598, 16/549, 16/549/598, 16/597, 29/63/134/520/597/598, 29/63/ 520/537/538/598, 29/134/237/537/538/567/571, 29/237/ 520, 29/237/520/538, 29/237/567/598, 29/237/597, 29/597/ 598, 36/92/549, 36/134/237/520/537/538/571, 36/134/237/ 567/571/597/598, 36/520/537/538/597, 43/46/56/148/258/ 279/363/549/571, 43/46/63/258/295/426/560/567/571, 43/46/196/319/549/560/567, 43/279/549/560/567, 46/295/ 319/426, 46/560, 95, 134/237/520/597, 134/520/597/598, 220/222/597/637, 224, 237/520, 237/520/537/538/598, 237/ 520/537/598, 237/520/538/597, 237/520/567/571/597, 237/ 520/597/598, 237/538/597/598, 237/571, 237/597/598, 279/ 319/560, 294, 295/549/560, 343, 433, 483, 486, 520/571/ 598, 520/597/598, 549/598, 556, 564, 567/571/597, 568, and 609, wherein the amino acid positions of said polypeptide sequence are numbered with reference to SEQ ID NO: 2.

8. The engineered galactose oxidase of claim 1, wherein said engineered galactose oxidase further comprises at least one substitution or substitution set at one or more positions in said polypeptide sequence selected from 4/43/46/426/ 549/560, 36/63/520, 95, 394, 483, 520/597, 556, 562, 568, and 598, wherein the amino acid positions of said polypeptide sequence are numbered with reference to SEQ ID NO: 2.

9. The engineered galactose oxidase of claim 1, wherein said engineered galactose oxidase further comprises at least one substitution or substitution set at one or more positions in said polypeptide sequence selected from 63/196, 173, 189, 194, 196, 197, 198, 198/447, 220/294/296/332, 290, 292, 327, and 638, wherein the amino acid positions of said polypeptide sequence are numbered with reference to SEQ ID NO: 2.

10. The engineered galactose oxidase of claim 1, wherein said engineered galactose oxidase further comprises at least one substitution or substitution set at one or more positions in said polypeptide sequence selected from 16/43/220/258/ 538/637, 18, 24/222/237/520/538, 24/222/520, 43/222/237/ 258/426/597, 63, 63/95/173/343/564/568/609, 95/173/258/ 426/556/564, 95/173/556/609, 173/556, 194, 222/237, 222/ 520/597, 237/258/549/597, 237/265/279, 258/267, 258/426, and 258/538/549/637, wherein the amino acid positions of said polypeptide sequence are numbered with reference to SEQ ID NO: 2.

11. The engineered galactose oxidase of claim 1, and wherein said engineered galactose oxidase further comprises at least one substitution or substitution set at one or more positions in said polypeptide sequence selected from 18/95/ 327/548, 28, 36, 43, 43/46/56/63/191, 43/237/279/538/597/ 598, 43/237/294/538, 43/237/520, 43/237/520/549/598, 43/237/520/597, 43/279/294, 43/538, 43/549/597, 51/55/ 111/150/367/564, 55, 61, 95/327/548, 99, 183, 198, 224, 229, 237/520/538/597, 243, 252, 258, 291, 295, 312, 335, 342, 343, 367/371/564/594, 371, 384, 468, 485, 520, 544, 549, 564/604, 567, 568, 570, 594, 596, 604, 635, and 637, wherein the amino acid positions of said polypeptide sequence are numbered with reference to SEQ ID NO: 2.

12. The engineered galactose oxidase of claim 1, wherein said engineered galactose oxidase further comprises at least one substitution or substitution set at one or more positions in said polypeptide sequence selected from 28, 28/99/520/ 637, 55/295, 55/342, 55/568, 55/568/594, 55/568/637, 61/224/343/520/637, 99/343/637, 99/520/637, 99/637, 224/ 520/637, 295/342, 295/342/568, 342/568, 342/594, 343/520/ 637, 403/520/637, 520/637, 568/637, 594, and 637, wherein the amino acid positions of said polypeptide sequence are numbered with reference to SEQ ID NO: 2.

13. The engineered galactose oxidase of claim 1, wherein said engineered galactose oxidase further comprises at least one substitution or substitution set at one or more positions in said polypeptide sequence selected from 13, 13/26/156/ 274/359/429, 13/156/262/274/315, 13/156/262/315/429/ 437, 13/156/274/437/568/606, 13/262, 13/262/274/380, 13/262/274/595, 13/262/437/488, 13/274, 13/274/315/437, 13/274/373/437, 13/328/437, 13/373, 13/437, 13/437/541, 26/262/274/315/437, 35, 37, 37/89, 37/89/274, 37/263/274/ 380/559/561, 37/380, 45, 45/262/274/373/437, 89, 89/263/ 274/380, 89/263/559, 89/274/380, 105, 154, 156, 156/274/

315, 200, 217, 217/274/380/561, 217/274/478, 217/354/380, 217/380, 224, 239, 241, 253, 262, 262/274, 262/274/315, 262/274/437, 262/373/595, 262/380, 262/437, 262/541, 263, 263/274, 263/274/380, 263/354/380/559, 263/380, 263/380/ 441, 274, 274/328, 274/354, 274/359, 274/373/437, 274/ 380, 274/380/441, 274/380/559, 274/393/437, 274/437, 274/ 437/541, 274/437/568, 315, 328, 336, 354, 354/380, 359, 366, 373, 373/595, 375, 380, 380/437, 380/559/561, 393, 429, 437, 438, 439, 441, 478, 478/561, 488, 541, 550, 559, 561, 568, 595, 605, 627, and 641, wherein the amino acid positions of said polypeptide sequence are numbered with reference to SEQ ID NO: 2.

14. The engineered galactose oxidase of claim 1, wherein said engineered galactose oxidase further comprises at least one substitution or substitution set at one or more positions in said polypeptide sequence selected from 13/99/156/262/ 437/559/641, 13/99/156/380/437, 13/99/156/380/437/559/ 563/641, 13/99/257/262/263/559, 13/99/262/263/380/437/ 563/641, 13/99/263, 13/99/263/380, 13/99/263/380/437, 13/99/263/380/437/641, 13/99/380/437/559, 13/99/437/563, 13/99/563/641, 13/156/262/263/437/559, 13/156/263/437, 13/156/380, 13/262, 13/262/263, 13/262/263/380/437/559, 13/380/437, 13/380/437/559, 13/437, 13/470/559/563, 29, 30, 43/46/56/63/99/156/262/263/403/559/563, 62, 99, 99/156/262, 99/156/262/263/380/437/559, 99/156/262/263/ 437, 99/156/262/263/559, 99/156/263/559, 99/156/380, 99/156/380/437, 99/156/437, 99/262/263/437/559/641, 99/262/437/559, 99/263/437/563, 99/380/437/559/641, 99/380/563, 99/437, 108, 149, 175, 177, 184, 194, 197, 208, 234, 251, 254, 262, 262/263, 262/263/437/559, 262/263/ 559/563, 262/437/641, 263/380, 263/437/559/563, 278, 280, 287, 356, 373, 380, 407, 409, 463, 466, 489, 559/641, 565, 569, 592, 596, 601, 610, and 615, wherein the amino acid positions of said polypeptide sequence are numbered with reference to SEQ ID NO: 2.

15. The engineered galactose oxidase of claim 1, wherein said engineered galactose oxidase further comprises at least one substitution or substitution set at one or more positions in said polypeptide sequence selected from 29/149/463/601, 29/177/197/592, 29/177/463, 29/197/592, 29/463, 62/208/ 417/615, 62/286/615, 62/373/466, 62/466, 62/466/597, 149, 149/208/615, 149/463, 177/194/197/463/565, 177/197/463/ 565, 177/280/463/594/601, 177/463/565, 177/463/592, 184, 197, 197/280/463, 197/463/592, 197/466/569/596, 208/251/ 259/278, 234, 234/384, 251, 251/399/615, 278, 373/466, 384/569, 399/615, 417/615, 463/565, 466, 546, 569, and 569/597, wherein the amino acid positions of said polypeptide sequence are numbered with reference to SEQ ID NO: 2.

16. The engineered galactose oxidase of claim 1, wherein said engineered galactose oxidase further comprises at least one substitution or substitution set at one or more positions in said polypeptide sequence selected from 3, 4, 9, 18, 26, 29, 30, 38, 40, 42, 43, 44, 48, 50, 75, 79, 135, 136, 142, 156, 159, 161, 197, 486, and 601, wherein the amino acid positions of said polypeptide sequence are numbered with reference to SEQ ID NO: 2.

17. The engineered galactose oxidase of claim 1, wherein said engineered galactose oxidase further comprises at least one substitution or substitution set at one or more positions in said polypeptide sequence selected from 29, 29/30/50/79/ 136/197, 29/30/50/79/197/407, 29/30/79/136/156/197, 29/30/79/197, 29/30/79/197/407, 29/30/136/197/407/486, 29/30/136/407, 29/30/197, 29/30/197/407, 29/50/197/407/ 486, 29/197/407, 29/197/407/486, 30, 30/50/79/136/156/ 197, 43/197/407, 50/136/197/486, 65, 79, 79/136/197/407, 79/156/197/407, 136, 136/197/407, 136/197/486, 156/161/ 486, 197, 197/407, 197/486, 486, and 615, wherein the amino acid positions of said polypeptide sequence are numbered with reference to SEQ ID NO: 2.

18. The engineered galactose oxidase of claim 1, wherein said engineered galactose oxidase further comprises at least one substitution or substitution set at one or more positions in said polypeptide sequence selected from 24, 47, 63, 78, 95, 119, 121, 197, 207, 214, 219, 220, 249, 294, 324, 365, 408, 414, 437, 480, 485, 520, 556, 571, 598, 600, and 626, wherein the amino acid positions of said polypeptide sequence are numbered with reference to SEQ ID NO: 2.

19. The engineered galactose oxidase of claim 1, wherein said engineered galactose oxidase further comprises at least one substitution or substitution set at one or more positions in said polypeptide sequence selected from 14/130/257/472, 14/257, 24, 29, 29/136, 29/136/197/436, 29/136/436, 29/136/436/453, 29/197, 29/197/342/436, 29/197/436, 29/197/436/453, 29/197/453, 29/436, 29/436/472, 29/453, 29/472, 43, 63, 95, 119, 130/421, 136, 136/197/436, 136/ 197/436/453, 136/436, 144, 197, 197/436, 197/436/453, 197/436/472, 197/453, 214, 219, 249, 257, 257/472, 297, 359, 436, 437, 460, 485, 495, 520, 556, 560, 567, and 592, wherein the amino acid positions of said polypeptide sequence are numbered with reference to SEQ ID NO: 2.

20. The engineered galactose oxidase of claim 1, wherein said engineered galactose oxidase further comprises at least one substitution or substitution set at one or more positions in said polypeptide sequence selected from 24, 24/51/63/ 197/359, 24/119/197, 24/197/249/437, 43/197/359, 43/249, 63, 63/67/197/571, 63/67/214/556, 63/119/197, 63/119/197/ 207/214, 63/119/197/339/341, 63/119/197/556, 63/119/197/ 556/571, 63/119/556, 63/197, 63/197/207/556, 63/197/207/ 556/571, 63/197/214/571, 63/197/249/495, 63/197/556/571, 95/197, 95/219/359, 119, 119/197, 119/197/207/571, 119/ 197/214, 119/197/214/556, 119/197/214/571, 119/197/339, 119/197/556, 119/197/556/571, 119/197/571, 119/207/556/ 571, 197, 197/207, 197/207/214/471, 197/214, 197/219, 197/339/556/571, 197/556, 197/556/571, 197/571, 214/249/ 359, 219, and 556, wherein the amino acid positions of said polypeptide sequence are numbered with reference to SEQ ID NO: 2.

21. The engineered galactose oxidase of claim 1, wherein said engineered galactose oxidase further comprises at least one substitution or substitution set at one or more positions in said polypeptide sequence selected from 194/330/495, 196, 246/408/442/462, 246/442, 292, 327, 327/329, 330, 407, 442, 442/462/515, 462/583, 498, and 583, wherein the amino acid positions of said polypeptide sequence are numbered with reference to SEQ ID NO: 2.

22. The engineered galactose oxidase of claim 1, wherein said engineered galactose oxidase further comprises at least one substitution or substitution set at one or more positions in said polypeptide sequence selected from 14, 14/24/36/96, 14/24/36/296/424/560, 14/24/78/120/258, 14/24/92/96/99/ 408, 14/24/96/258/626, 14/24/258/560, 14/78/120/258/488/ 560/626, 14/92/96/99, 14/92/96/99/120/537, 14/92/96/120/ 376, 14/92/99/120/537, 14/95/120/296/480/560, 14/120/ 480/626, 14/258, 14/258/296/560, 14/376/560, 14/408, 23/36/92/95/96, 23/36/92/95/99/408/596, 23/36/408/428, 23/36/537/596, 23/218/537, 23/408/596, 24, 24/36/46/99/ 426/532/549, 24/36/95/96, 24/36/95/99/404/426/485, 24/36/ 96/99/532/549, 24/36/99/404/426/532/549/600, 24/36/120/ 296/480/560, 24/36/404/426/532, 24/36/404/480/485/532/ 560/600, 24/46/92/404/426/532, 24/46/92/426/532, 24/46/ 92/426/549, 24/46/95/99/426/532, 24/46/99/426/549/600, 24/46/404/426/485/532, 24/96/404/426, 24/99, 24/99/404/ 485/532/600, 24/296, 24/296/324/480, 24/404/426/532, 24/404/480/485, 24/404/480/532/549/560, 36, 36/92/95/99/ 404/426/560, 36/92/95/428/596, 36/92/96/408/428/540/596, 36/92/485, 36/258/296, 36/258/296/324/433/626, 36/404, 36/404/426/549/600, 36/408/537/596, 36/408/596, 36/426/ 485/600, 46, 46/92/560, 92, 92/95/485/532/549/560, 92/99/ 218/560, 95, 95/120/296/626, 95/404/426/532, 96, 96/99, 96/258/560/626, 99, 99/404/426/560, 99/426/480/485, 120, 120/324/480/560, 218, 218/408, 296/324, 296/324/560, 324/ 560, 404, 404/485/600, 408, 480, 485, 532, 537, 537/640, 549, 549/560, 560, 596, and 600, wherein the amino acid positions of said polypeptide sequence are numbered with reference to SEQ ID NO: 2.

23. The engineered galactose oxidase of claim 1, wherein said engineered galactose oxidase further comprises at least one substitution or substitution set at one or more positions in said polypeptide sequence selected from 14, 14/24/36/96, 14/24/36/296/424/560, 14/24/78/120/258, 14/24/99/218/ 408/537/560, 14/24/258/560, 14/46/47/376, 14/46/96/99/ 560, 14/92/96/99/376/560, 14/92/96/120/376, 14/92/96/376, 14/92/99/120/218/408, 14/92/99/120/537, 14/92/99/218/ 408, 14/92/218/408, 14/95/120/296/480/560, 14/376, 14/376/537, 14/376/560, 14/408, 14/537, 23/36, 23/36/92/ 95/96, 23/36/92/95/99/408/596, 23/36/96/408/596/640, 23/36/408/428, 23/36/537/540/640, 23/36/537/596, 23/218/ 596/640, 24, 24/36/46/99/426/532/549, 24/36/95/96, 24/36/ 95/99/404/426/485, 24/36/96/99/532/549, 24/36/120/296/ 480/560, 24/36/404/426/532, 24/36/404/480/485/532/560/ 600, 24/46/92/404/426/532, 24/46/92/426/532, 24/46/92/ 426/549, 24/46/95/99/426/532, 24/46/99/426/549/600, 24/46/404/426/485/532, 24/96/404/426, 24/96/404/426/560, 24/99, 24/296, 24/404/426/532, 24/404/480/485, 24/532, 36, 36/92/95/428/596, 36/95/96, 36/99/426/485/600, 36/258/ 296, 36/258/296/324/433/626, 36/404, 36/404/426/549/600, 36/408, 36/408/537/596, 36/426/485/600, 46/92/560, 78, 92, 92/95/485/532/549/560, 92/96, 92/99/120, 92/99/218/560, 92/218, 92/404, 95, 96, 96/99, 99, 99/426/480/485, 99/640, 120, 120/324/480/560, 120/376, 218/537/596, 218/596, 258, 296, 296/324, 296/324/560, 296/480/560, 324, 361, 404, 404/426/485, 408/596, 424, 426/485, 426/532/549, 480, 532, 537/640, 549, 549/560, 560, 600, 626, and 640, wherein the amino acid positions of said polypeptide sequence are numbered with reference to SEQ ID NO: 2.

24. The engineered galactose oxidase of claim 1, wherein said engineered galactose oxidase is a variant engineered polypeptide set forth in SEQ ID NOS: 4, 166, 272, 928, 932, 1264, 1416, 1598, 1866, 1912, 2080, 2300, or 2424.

25. The engineered galactose oxidase of claim 1, wherein said engineered galactose oxidase comprises a polypeptide sequence that is at least 95% identical to the sequence of an engineered galactose oxidase variant set forth in the even numbered sequences of SEQ ID NOS: 4-2860.

26. The engineered galactose oxidase of claim 1, wherein said engineered galactose oxidase comprises a polypeptide sequence set forth in one of the even numbered sequences of SEQ ID NOS: 4-2860.

27. The engineered galactose oxidase of claim 1, wherein said engineered galactose oxidase has at least 1.2 fold improved enzymatic activity on a primary alcohol as compared to the galactose oxidase of SEQ ID NO: 2.

28. The engineered galactose oxidase of claim 1, wherein said engineered galactose oxidase is purified.

29. A composition comprising at least one engineered galactose oxidase of claim 1.

\* \* \* \* \*